United States Patent 10,279,031 (COMPOSITION COMPRISING ANTIGENS AND A MUCOSAL ADJUVANT AND A METHOD FOR USING) - sequence listing, part 5

SEQ ID NO: 5 - DNA, 2280878 bp, Haemophilus parasuis
gtcatgatcaacaggcttgggtagttgtatctgagttagtaaagtctcataccaaaacatccgcttgcacggataaaagagctcaagtatgcacctcagattattttttagataaacagcaagataaatttaaattaagtcttttaagtctagtattactaggtatattttttagtccaccggcaggttcagctactcactcaggaacaccatatactgcagatggtggtagtaaatcggatagaggatctgacgacggtactattagtattggtaaaagtagtagggcttcgtatggtgctattgctatcggtcagaagtcaaaagctgaaggtaggcatggtattgcgataggttatcaaacaaatgcaggaacacacgtaaactctgttgcggtaggcaacgatattcaagtaagtggggaggaagcagttgccatcgggagtagttcaaaagcgggaaagggatctgttgtcttaggcagacaagccgatgcggcaaatattgaacaagcagttgtaataggtaaccttgctaaagcaactggggcacaatctattgctatcggggcaaataccaaagcggaggggtatggctccatatcaatcggtggagatgatttaaaaacaacgaaatatcaaactggtaatcaaggccaatccaaaacaacaactgcgaaaggtaaagcctctgttgctattgggggtggttctttggctaagggcgaaggatctattgttttaggtcctttagcatctgcaaataaagatgaaggcattgctatcggtgcgagaagtagttctaccgctgagtacggtattgcggttggtggtggtgcaactgctggaaaaaacgccgttgctgttggtagggactcgaaaggtgctgggacagattccattgcgataggtaattctgcgagaacaacaggggcagactctgttgttgtgggtgccaatatcaatgtgacagatggacaattagtggcaattggataccaagcaagtgctaaaagtcgttctactgccttgggttataaagcctctgccggtggtatgcactctgttgctgtgggtgaaagtgccatgacaaatgatggtgctgctagagcaaccgcacttggtaataataccgttgtcaccgtgggtggcggtgtggcattgggttatgggtcaagagcagaaacgagagggggtattgaaggagcaaaacaaacttattctgtcacaacgggaggaagcactgttgataacggctttaaatctacagaaagtgttgataacaatcttattcctattggtgcggtttctgtgggtaatgacaaaatcaaacgccaaatcgtcaatgtggcggctggtacacaagataccgatgcggtaaacgtggcacagcttaaatctttaaccctgaaaattgcaggcaataccagcgaacaaacacaaccacaaccagcggttggcttgtggagtggtacgcttaaagtagtgggtacaagcggtgagattaagacttccgcaagcggtgataccatcacattgaaattagatgaaacattgaaaaacaaaattgataagattgacaatttaggttggaaacttaaaattgctcagggaatggggggtaaagcaacaaatccacctacggaacatcttgtcaaaatggacaagaccgtaacctttaccgctggaaataatattaaattagaacaaatggacggaaatattacgatttctacgattggtaagttaattacaaagactgaaatggtaaatggtgatttgaaaattacctatacagataattcgcatgacattatcaagaaaggtgaaaaaggagatcgtggcgaaaaaggtccaaaaggcgatagaggagaaactggctctgcgggtccagcgggtccagcaggtgctcaaggtccagtaggtccaaaaggagaggcaggagcaaaaggtgataggggtgaccgtggtgaagcaggaccaatgggccctcaaggtcctgcgggtgcaactggccctgctggtccagcaggggctgctggtctagtaggaccaatgggccctcaaggtcctgcgggtccacctggtcctgtgggtccagcaggggctgctggtcctaagggggataaaggcgaaccaggacaagcgggtccagcaggtgctcaaggtccagtaggtcctgcgggtccagtaggtccaactggaccacgaggtacacctggtcctgcaggaccaaaaggagaggcaggagcagctggacctaagggtgagaaaggtgatccaggaccaaaaggcgaagctggttcaacaggtccaacggggcctgctggtccaaaaggagatacaggtcagaaaggtgaaactggccctgcgggtccagcgggtccaaaaggtgatacaggtcagaaaggtgaaactggccctgcgggtccagcgggaccacaaggccctgcgggtccaacgggatcacaagaccctgcgggtccaactggaaattcggaattaaaaggcattacgtcgattgccaatggtaacgacgccaccaaggcgaatggggctaagattaccttgtctgcaggttctacagataaaacagttaatgttaatgatgcgaaaattaccaatgtggcggctggtacagcagatactgatgcggtaaatgtgagccagttaaatactaaggcagcagcttcaaaaacagaggttaaatcaacggacaaatcggttggcgttacagcaagtaaaggtgacaaagatcaaacgatttatgatttatcggtggtgaaatctaaattgaaggctgctgaggataaacgtacagttacggctgaaaccaagggcaatgcttttgtaacaggtgaggaagtggcgaatgccatcaacaccacaacagcagccgcaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaatttctgataatggcaaatggcttattcgagcgtctgttagcagtaatactcagcgggatactatgattggaggaggggtaggttttgtgtggtaatctagcacctataaattagaatttcatgctcaatgccattgttattttaacaatggcattgtttggtaatgccttatatatggcagcactatcggcaattcgctttgaacctgtttttaaagccttttacacccgattggttgcaaaaggcaaagcgaagaaagtcgctattatggcgtgtatgcgtaaactgctcaccattatgaattgacttttatgcaactgctgcattataccgattaaatctccgtcttctctttatactcacacaaatcttcaataatacaagagccacaacgaggcttgcgagcaatacaagtatagcgaccgtgtaaaatcaaccaatgatgaacatcaaccttaaattcatcaggcacgactttcaacaatttttcttccaccttaaccacatctttccctggggcaaaattagtacggttagaaacacggaaaatatgcgtatcaaccgcaatggtcggctgaccgaatgcggtatttagcaccacatttgccgttttacgtcctacacctgcaagagcttctaattcttcacgggtttgaggtacttcgccattatgtttttcaattaaatcacggcaagttttaataatgttttccgccttgctgttataaagcccaatggttttaatatactcttttagcccatcaagccctaaatctaaaatcgcttggggcgtatttgccacaggataaagttttgccgtggctttattgacccccacatccgttgcttgagcagataaaatcaccgcaatcaataattcaaaagggttggaataattgagttctgtggttgggtgagggttctcattgcgtaaacgggttaaaatttcaatacgtttttctttgttcattcattatcctataaaagcaaaatagctctgatcccacaacatttttaccaccataataaacgacatcataacaatcaacgggcgaataatctgttttcctttggtgacaaccattctcgcccccaatgaagccccgataaattgtccaatcatcattagaaaaccgattttccataaaatcgcaccgccaatgatgaagaaaatcagcgaagcaaggttagaggtaaaatttaacactttggagtgagcaacgctttgggtcaggttaaaaccaagtaataacacaaaagcgagcgtaaagaaagagcctgtggcaggcccgaatagcccatcataaaagcctattcccattgccgccgtgcaagcgaacatcggaaagctcattctttggcgacgttgttcatcgcctaggcttggactaaagagaaaataacagccaataattaagatcagaaaggggagggcaacttttaatgcattgacatctatcatctgcactaaaatagtcccgattgaaccgccgataaaggtcagcaaaataagcaaccaaatctgcttcaaatcgaccgcttttttacgcacaaaatagagcgaagcggaaaacgagccgccacaagcctgtaatttattcgtgcctaacgcaaccgtagggggaataccgactgctaataacgctggaatagtaatcaaaccaccaccgccagcaatggcatcaataaaaccagccacgaaagccgcaacaaataagataatcgcaacatcaagtccaagttccatatttccccctacgatctattaattaataatgcaccaccatttcatctcggtggaatactactgaaccaaattcatagcccaaaatggtttcaatctcgctagattttttgcctttgattaatgctagagcatcactgttataacgactaatgccaagggcaagcactttgccgttaaggttacaaatttttgccacttcaccacgcgcaaattgcccttcgattttggcaataccagtaggtaagagcgatttatgctgttctactaatgcgttttctgccccttgatcgatataaattgtgccagcaggcggcgcaccaaagagccactgtttgcgtccttcgattttgtcgtgttgagctaagaagcgtgtgccaatttccgccccttgtgccacttcaaaaatcacattcggacgttcgccagaagcaatcgcggtttcaacaccagaacgggttgcaatatcggctgcggtgattttggtactcataccgcctgtgcctaaggttgtgccacttccccctgccatttggcgaatttcaggggtgattttttcaacgacagaaatgcgtttggcatttggatttgaacgtggatcactgtcgtataacccttcttgatcggtgagcaaaatcaataattctgcttgggctaaaattgccaccagtgccgataaattatcgttatcgccgatacgaaactctgccgttgccaccgcatcattttcattgataatcgggataatttgttgatcgagcagagcggtgagcgtatcccttgcgtttaaaaagtggtctttattttcaatatctgcacgggttaaaagcatctgtccgattttgatgttataaatggaaaagaggctttcccacacttgaataagctggctttgtccgacggcggctaaaagctgttttgtcgccaaggtttttggcaattcacgatgccctaagtagtcacgcccagcggcaactgccccagaggtaaccaaaataacacggtagccttgttcatgtaattgtgcgatctgtttaacaatttctagcatatgtggacggcttagacttttagtgccgtgggttaaggtgctagtgcctaattttactacgattgtttttgccataatgatttgtaaaaagaaaagaaactgtttgctattatctgctataatcttttttatttcaaaagagttatgtcgctatgattcaaattagtttaattgttgcccgaaccttaaataaagtgattggcaaagataatgcaatgccttggcatttacccgttgatcttgcatggtttagagcaaataccgtaggtaaaccggttattatgggacgaaaaacctatgaatctatcggcagactattgccaaaacgcccaaatattattctttctcgttctgggttttgtatcgagggcgcttattctgcgacaagccttgaacaagcggtcactttagcgaaaagttttgcaaatgtagatgaaataatggttcttggcggaggggagctatttaaacaagcgatgccgttagcgaataaactttatcttacggaaattcaagcagagattgatggcgatacgttttttgagtttgatgaaactcagtggcagcaggttgcagagaagtggtctgaagtagatgagcaaaatagttaccgttgtcggtttatgattttggataggttaaaaaatgattaataaatgattaaaaaataacctctcctgattgtttgtaaaataattgtggttttattttgaacgaatgatagggttttatgtgatttatttcacaatttaataacattttgcttttttgtttacaaattttcactagaatatgagcctcaatattgacttttatggtgttttcttttttgaggtgttttatggctctgtttctcagtatttttcctatcgttttactgatttatttaatggtaaaacgcaacgcattaccttcctatgtcgctttaccgtggattgcggtagtggtgttaattatccagctaatctatttcggcaccgatattcaaacggtcagtgcgaatattgcttctgccttgattgcggtacaaacaccgattaccgtcattttcggtgcagtgcttttcaaccgtttttcagaagtatctggtgcaaccgatgtgttgcgtaaatggttatcgaatatcaacccaaatcctgtggctcagttaatgatcatcggttgggcatttgcctttatgattgaaggagcgagtggtttcggtacacctgcggcgattgcagcaccgattttagtcggtatcggtttccacccgcttaaagtggcaatgttggcattagtgatgaactccgtaccggtttcatttggtgcggtgggtacgccgacttggtttggtatgggagcgttacaattaggtgaagagcaaattttagaaatcggttctatcactgcatttattcactctattgccgcatttatcattccagtaatggcattgcgtttaatcgtgagctggtctgaaattcgtaaaaatatcgtgtttatctacatcagtatttttgcttgtgtgatcccttatttcctaattgctcaattaaactacgagttcccgtcattagtgggcggtgcaatcggtatggtgatctctgttttagtggcaaacaaaggtatcggtttagcgaaagtggataataccgttgatagcaatgccgtaaccactgcacaagtagtgaaagctttattcccaacaggtttattaattgcgatcttaattgtaactcgtattaaacagttaccattaaaagcaatgatgaacgatgcaacttcttggttcagcgtaaaattaggttcgcttggtgtatttgatattagccacgggttaattttcagcttaaaagaaattttcggcacaacaattagctcaaactacaaattgctttatgtgccagcattaatcccgtttgtgattactgtattaattgcaatccctgtatttgccgtatcagcgaaaaataccaaagagatcttcgcaacaagcttaaaacaaacgaaaaacccattctttgcgcttgtgggtgcgttaataatggtaaacttaatgcttgtaggcggtgatggttcaatggtgaaaatcatcggtcaaagtttcgcacaagcaacaggggaatactggactatcttcgcctcttatttaggtgctgtgggggcgttcttctcaggttcaaataccgtatcgaacttaacctttggtagcgtacagctttcaacagcaatggaaacaggattatctgtgagcctaattcttgctgcacaatctgtgggcggtgcgatgggtaatatggtgtgtatcaacaacatcgtagcagtatgttcggtattgaacatcaataataaagaaggtgaaattatcaagcgtacggttatgccaatgtttgtttacggtgtaattaccgcactttcagcactctttattgtgccgttgttctacaatgtgtaatcttaggtggggtattaccccacctttcgtttttaaatgttgaagaacaagcggagtattgtgataaaaatttggctatatatttgagagtagggatgccaagcgtggcgtccctacaatgacattgaatattgatattcgtaaaaaataaatccgaagtatttgtagggacacgacgcttcgtgtcctaatatttgaattggaagccaagcgtggcgtccctacaatataaaaagatttacaacataaatgccaaaaaatttgtaaaatccaaccgcttgttttagcttttttactatttttatttattggagtttttatgaacgtgaatttttacgtcacctgtattgccgatatcgtcaaagcaggtgttgccaaaaatagcgtgctattgttagaaaaactgggttgtaaaatcactttccttgaaaaacaaggatgctgtggacagcctgcaattaacagtggttatacaaaacaagcccttgagggaatgaaaaagttagtggaaacttttgaagtcaatgattatccaattgttgcccctgcaggttcttgtgtttatgcaattaaaacctatcctgaccattttgaacgctttggcgaaccagagtgggcggctcgtgcgaaaaaagtcgctgaccgttttcatgatttaacagattttatcgtcaataaactgggcgttaccaatgtcggtgcaaccttaacaggcaaagccgtttatcacccgtcttgcagtttgtcgcgtaaattaggtattgtgaatgaaccaatcaccttattacaaaatgttaaaggcctagagttgttaccaattcaaaatcaacaaacctgttgcggtttcggcgggactttctcggtcaaaatggcggaaatttcaggcgaaatggtcaaagaaaaagtcgagcatattgctgatgttgaaccagaatacttgatcggtgcagatgtgagctgtttgatgaacatcggcggacgtttaagtcgtgaagggaaaaatattaaggtaatgcatattgccgaagtattaatgcaggagggcaaataagatgtcactgaaaaccagcaatcttgcctttaaaaaacgcgtggacgatcaaatccacaacgcaatgatgcgtaaagcggtggtaaaagcccaagaaaccatcggggcaaaccgtcaaagaatggtggacgaacttggccactgggaagagtggcgtgacgcggcaaaacagatccgtaaccacgttcttgccaatttagacgcctatctctaccaattaagtgaaaaagtgcaacaaaacggcggtaaagtcttttttgcagaaactgccgaagaagcgaccgcttatatccgtcaaatcgccttagaaaaaaatgctaagaagattgttaaatccaaatcaatggtgacggaagagatcggcttaaaccacgttcttgaaaacgaaggcattaaagtggttgaaacggacttaggcgaatatttactgcaaatcgttggcgataagccatctcacatcgttgtacctgcaattcacaaagatcgctataaaatccgtcaagaattacacgaacaactgggctataacggctcagaaacgccagaagaaatgaccgcctttgtgcgtcaagtgatccgcaaagatttcttagaggcagacatcggtattagtggctgtaactttgccgtagcagaaacaggttctgtctgtttagtgaccaacgaaggtaacttacgtttagcgacaacggtgccaaaaactcatatcgctgtaatgggtatggagcgtctagccccaacgtttcaagaggttgatgtgttaatcacaatgctagcaagaagtgcggttggtgcaaaacttactgcctataacacttggctaacaggaccacgtcttgaaggagaaacggacgggccagaagagttccacttagttatcgtggataacggacgttcaaaaatccttgaaagcgaatttaaagaagttttacgttgtatccgttgcggtgcgtgtttgaacacttgccctgcgtatcgtcaaatcggcggacacggctacggctcgatctatccaggtccaatcggatcggtgatctcgccattactcggtggctatgaagaatttaaagaactgccttatgcttgttcactttgtaccgcttgtaactctgtttgccctgtgaaaattccactggcacaactgatcttaaaacaccgtgaacatatcgctcaaaatggtatgactccaacagcagagcgtttgtcgattttcggtttcaactttgctaactctcacccaactttatggaaagtcggggtgaatatcggggcaaaagtggcaggtaaattcatcaaaaacggcaaagcaccaattcaagtgggagcgcttgcagaatggacaaaagcccgtgatttaccgtcagccgaaggcgaaagtttccgtgaatggttcaacaacagaggataagagaatggatttacaaaaccgtgaaaattttctaaataaactggcggaaagaatgggcagaccgcgtcagctcgtgcctgaaccaatgccgaaattagtcaatgattatccaacgacacgcttaacggatcgcacccaagctcaattagtcgaggaatttgttagctttgctaaagtgatgatgaccgatgtggcggtggtgaaagaagaaaatctgatcgcagaagtgaccgctctttgtgacaaatatggcggcggctcggtgattattaataacgacagccgtctagtcgatttaggcattacaccagcattgcaagctaaatacgacagctatgtttgggatcacaattcagatggtagtgttaatatcgacaaagcagaaaaagccaatatcggcgtggtttacggcgaatacggcttaacagaatctggcggtattgtactgttttcagataaagagtttggacgttcagtcagcctgttacctgaaaaatccattgtcgtcttgcgtgccagcaccgtgttaccccgtgtggcacagttagctaaaatcctacacgacaaagcccaacaaggcgaaagaatgccatcttgcgtaaacattatttcagggccaagtgctacggcagatattgagttaatcaaagttgtcggcgtacacggacctgtgaataaggtttatgtggtgattgatgatctataaataaattgttactgcgaatggaatggttcaatcaaatgtgattgagccattttttattctagataaagcgtgataaaatccgcatcatttctatcttgaattatctataaaatggctaaacaaaatctcttaacggcacaaggtgagcgagtggcgattgttgctggattacgcacaccttttgttcatcgtgatacaggatttaaatcttcctatgcaacagatttaggcacaatggtaacaaacgagctacttagtcgtactgccgttgatcatcaacatattgaacagctcgtctttgggcaagttattcaacagcctgatattcctaacccttctcgtgagattgccttggcgttaaatatgccttatgtgcaggcttatactttaagtagctcttgtttatctgggttgcaagcgttggtgaatgtctccggcagtattattagcggttcgatttctgcaggaattgcagggggaacggactcgatttctaatgccccttttagtattagccctcgtgttattcataagctcaaggcaatttttaatgctccaaccttagatgataagtatcgcttgttccgtgagttttcgtggaaagagcttaaacctcacggggttaatctcaaagattatatgacccaaatgtccgtggcggaaatttctgagcagatggctcagcagtttcacattagccgtgaagctcaggacgaatatgcgttaaattcacatatcaaagctcagaatgcgtggaaattggggctgttaaaagatgaagtaatgccttcgtttcctcgtccttataccgattttgtggtatctgacagtttgatttcctctgccacaaaagcggcttattatgaaaaattttcgccgttaatgaataaaagttatgccactgtgaccgaagcaaatatgcctcgtacggtggacggtgcggcggcagtgttattgatgcgagagaacaaggcgaaagaactggggttagagccgttaggttatattcgtagctatgccattgcgggtaacgatatttggcaaaatatgtttatgggggcgacggttgcaagccatcttgcccttgagcgtgcgaatgtgagcttgtctgatttggattttgttgatattcacgaaacctcagccagccaaatgttggttaatatgaagctgtttgcttcagatgaatttgcgaaaaaacagcttaatcgttccgcttgtattggggaaatcgatcctgagaagttgaaccatttgggcggttctattgcttttggtaatcctcgtgcggcgaccagtttacgcattttagttcaatcgttaaaagccttgaaacgcaagggaggcggattgtctttgattgcctcaagtggattaggtggattaggttctgcaatgattttggaaagcgagtaacagtatgacaacacaagcacaatatatctcaccttttcacgttgagattgatgataatcgaattgccattgtttgtattgatgtaaaagggaaatcgcaaaactggttgcctgagcagtttattgaagatttacgtgatgtgattggttctgtgatttatcaacaagcacggggcgtgatttttgtttcgggtaaggagaaaggttttattcaaggttatgatcctgatcatttgcgtggtaaaaatgatgaacagctgaaaaccttatctcataatgctcagttggtgatgcgtgaaattaatacgctcaaaatgcctgcggtggcggtgattgatggtggctgttatggcgttgggctagagttggcattggcgtgcgattatcgtattgccagcgaggaaggttataccaaatttgcaatgccacaaattcgttcggggattttgccttttgctgggggaacacagcgtttgcctcgtttggtcggcttgcaaaatgcggtcacgatgttgctatctggacagaaaattggggtggaaaaagccctgaaaattgggctggtggataaacttatccctgccagtaatttatttgaaacggcatatcagttattgcttaaccataaagtgcaaaaagtggatcataaaaatccgcttgataaggtcaaaaaatggcgtaaacagcttgagggcaataagtttatccgtgaaaaatatctggctcatattgaaaatcgtgtttgggataaagcctttggcaactatcctgcggttacagagatgttggcattattgaaagagcctcattttaaagccgggttggcattagaacaaaatgcgttagtgaacctaatgcacacggagcaagctcaggttttaatgaatttgaaacagactgagcgagcgatgaaggagcaatatcaacacttggctcaagtgcgagatgtacaacaagtgacggtgctgggtagtggttatatgggggctgggattgcttatttgacggcaaataatgctcaaattccagttagaattaaggatattcacccgtcggaaattcaaaaagcattgcaaacttgctatggcttaatgcaaaaagcggtggataagaaacagctcagccacggtgagatgatccaacgaatgaatttaattacgggtggtgagcgtttagttgcggcgaaatcgacagattttatcgtagaggcagtttatgaaaaattagaactcaaacagcagatggtgcaagagagtgaaaattactacgaagaaaatgcgatttttgccacaaatacctcaacctttgcgatccgtgatattgcttctgtcgccaaacgccctgaaaatgtaatcggttttcactatttcagccctgtgactaaacgtccgatggtggaaattattccacacgaaaaaacttgccagcgagcggtttcaacggcaattcattttgcgatccagcaaggaaaaattccgatgcttgttgcggataaagaagggttctttattaaccgtattcttacgccgttcttacttgaagcaatcgagtgtttatccgaaggggaagggatcgaatttatcgaccgtgccttacaggaatttggctttaagatcggaccgcttgcaatgatcgatgaaattggcttggatattattgttaaatctaatccagcgatggtgagtgaattgggtaaacgttttgctttaccgacgactattgagcgtttgactggcgatgatcgtaaagggcgaaaaaataaacggggcttctatctctacgacacaagaggaaaacgcactcaagaggataagagtgtttatcacacaatggaaaccattatgcaaaatgaaatggaagccgaagatattgcccgtcgttgtgtattgagaatgttgaatgaagcctgctggtgtttacaagatcaagttattcgttccaccgatggaggtaacgttgcttctgtatttggggtggatttcccagatttccgaggcggtgtgtatgcctatattgacaagattggggctaaagagcttgttcgtcagttacgcaaacatacacaacaatatggcgagcgttttacgccttgtgagtggttggtagaaagggcggaaaaggcataactaaaggctttctaccattttaattgagagataataaagaggaacaacaatgaaattaactaaaatcacccttgctctggctggcattcttggcattgctgttgttgggggcagttggtacacagggcaacaagcagaacaacgctatcagcaattggttcaacaaggtaatcaaagcctgaaaacactgaagatctatggcatagatgcagaaattaaagatgttaaatttgaacgccattttttcagttctgatgtgaaatataccttagaggtaggaacggttgatgaacgttatcagctacaaggcgatgataaactctttcacggtccattaccgttaaatcgccttagccaagtgaacttaatgcctgcaatgatgagcgttgagagcaaactttatttacctgaaaaattcaagctacagaccccatttaccgaagggcaaacggatattagctacgcaggtaatttaagcggtgagtttagcctcaatgctttcaaaggtgaaacttgggatcttgcaaagacccagattgagttcgagtacgatccagcacaaaaatcggggaaattcagtagccaaattccgtcctatcaatatcaagatcaaacaaatactaggatagaaatccaagataccctttacaaagcggattttacctcaaatgagaaatatccagagcttagtttgggtaattatgagttcagttctaaaatggttcgttactcgtctgacggaaaagcaccttttgctttcacaaatctttccagtcagggtaaaaatacgttagaaaaggatcgctggacttcaacgggtagccttactggtgagttgctcgctcaagataaacttaacttaggtaagctcaacattgatagctcggcagagcttgatgcagagagtgctaatgaattaatgcattatgcctcttccttggaaaaattagaatctgtggaagctggcgatgtggtgttatcacttcttaacaaatcacctaaattacaaattaaagaacttagcttagagaatgcgaaagggaaaaatagcctatctttaaatctaaatttagataaatttgatccaagccaattcaatggaatggaagatgttctaaaaatctttaaagcgtctgtgttagaaactcaattcaagttgccttcattagaattattcatggcacagctaaatcaactagatggtttcccgaaagaagacgctgaacagaaggcaaaacaaacgatcagtgagtttgcctatcaagctcaagccagctcattagctacttcggataaagatagcctgaaaatgaaattgtccattgatcagggaaaagtcaatttgaatggcagagatgttcctgaagctgcagtgcaaggggcattgtttatgataatgcttgggttaaatcattgataagtaaataggcataagtactactcttatgcctgtaaacaggggttaattttcacgtttcacaataaattcagccaaagcaacaagagccgtagtatcaaaaggcaaggtttctagtgcttttagggctgtctggtagaggctctccgctttttgtttcgccccctctaaacccagcagttttggataagtgcttttatccaacgcttgatctgaacctgcggttttaccaatgacctcactattaccaatcacatcaagaatatcgtcttgtacttggaaagccagcccgattgctttagcatattgcacaagttgttgtttaatctgatgatcttgggcgtaagcggatagattaaatcccatcattacagaggcaaggatcaacgccccggttttattacgatgaatacgttcaagttcatcaagggcaatggctttatgctcagattgtaaatctaaactttgccccaaacacataccttttgccccagcggattttgcaagccactgcatttgtgccaccttctgctctgcggttagacttgggtcaaacgctagtaattcaaaggcaaaactttgtagtgcatcgccagccaaaatagctgttgcttcatcaaaagcaatatggcaagttggcttgcctcgacgaagggtatcattatccattgcaggtaaatcatcgtgaaccaatgaataggcgtgaatggcttccattgcccctgctgaatggtcaagttgagcaagtggtacgcctagcattttccctgtagcataaattaagaaagggcgaactcgtttgccaccaagcaaaacagcataagacatcgcgtcaataagcggtgtgttgtaggccggatattgcgaaagttgctcgcttagaaaatggttgatacgttgttgatattgacttaattcagcgaaaaggtcgtaattcattatgggtaatccgtaagatctgcgtgttcatttttttgtagcaaaatttggatacgttgttccgctttttgtaagcgttcttgcccttgttgcaccaattttactgcggtttcaaactcatttaaggcttcttctaaaggaagatcgcccgtttcaagacgattgacgatttcctcaagctctttgagtgtggtttcaaaatctagggtaggtttctttgccatagtctattccttttcaaataatcccgatattttacttgagaaagatataaaagtagatgattttctgctattgtttatcgcctaaatttagaggggagcttatgcaagtcacacaaatttgtctttatccaattaaatccactaaggcgtatcgggtagagcaggcttttgttttaccacaagggctgaattttgaccgtgaatttatgattaccgaagtcgatggtacttttatcacggctcgtaaagagcagatgttatatcgtttagcggcatttcctatttcaacggggattgttattcaatctgattgtggcgagcggtgtgtggcacggtataatgattttacgcaacagcaatctagcgaagtgtggggaaaccattttccatcttgggtggcgaatagtacagtaaatcaatggttaagccaaaaatttgggcgtgaagttcagttacgttggttaggcgaacagccacaacgaatggtaaaacattgtgaacctcaaccgttaagttttgcagacagtaatccgcttttattggtatctgagcaatccttaaaacaactacaacaatggtcgcctgtgcctgtttcaatggaacagtttcgagcaaatgttgtcatagatggcattcaagcctttgaagaagaagggtggaagagggtgaaaattggcacagtggaatttgaggtggctcaaccttgcacacgctgtattttaattacccgagatccacagacccttgaattagatccgaatacagaaccttttcggaccttaaaacaacaccacaccaatgagaaaggcaagccaatttttggggtgcatttagtgccacaaacaagcggtgttattcgagttggggattacattacaatttcagagtaattttatgcaaaaaaatacccgctttattttgtttccgatttttttctttatcggattaaatttaatgattttcagcctgtcacgccttggattatctctgtggcaagcagatcgtgtttctgcggttgagggctggtttcctcttttcctacaaggcttgcggatggatattgtctccatttgttatctctttggcgtaccagcattatttacggtgttattggtgcataacaatgggttaggcacactttggaaaggtattttacgcgtttggcttacgataagcagtgtgtttattctatttatggaagtcgccacccctgcgtttattgaaacctatgatttccgcccaaatcgtctatttattgagtatctactttatccaaaagaagtatttacaatgttagccaatgggcatttgactgcggtgattagcagtttggttgcaaccacagttgcaggcattatttattggaaactgtctggctgggctgtgcaacatctgcgtttacctagctggaaactgcgtcctgtaatggcattgttgattattgctgtggcgtttgctggggcaagatcatcattgggacatcgtggcattaaccctgcaatggtggcattttcaagcgatccactggttaattcattggttctcaattcaggctactctgtattatatgccgtacaacagctgaaagatgaagaaaaatcttcagagcaatatggcaaaatgtctgaacaagagatgtttgagattgtaaaaaatagccgtaatcgccccgcttctgattatatttcaacggttattccgacattaaccaagaatgtggcaagctatcaaggtaagcctaaaaatatcgttattgtgctagaagaaagtcttggcgctcagtttgtcggcacattgggcggtaagccacttactcctgaatttgatcaacttgctaaagaaggttggttgtttgaaaatatctacgcaacaggcacacgttctgtgcgtggtattgaagctgttactgcaggttttacaccaacgccagcgcgtgcaacagtgaaattaaccaaaagccaaaacggtttctttaccattgcagaattattgcatcgtcaaggttaccgcacctctttcatttatggcggtgaaaaacatttcgacaatatggcgagctatttttatggaaatggctttgaaaccatcattgatgagaaagattataaaaatccgaagtttgtttccacttgggggatgagtgacgaagatttatttgataaagcacacgaaacctttaccgaattagcaaaaggcgataaaccgttttttagcttagtctttacttcaagtaaccacgatccatttgagttcccagacggtaaaattgagttgtttgataaagagaaacagacccgcaataatgcggcaaaatatgcggattatgcgttagggcatttcttcaaattagcaaaacaatcaaattattggaaagatacggtattccttgtcattgctgaccacgactcgcgagtagcgggtgatagtcttgtgccgatcaaacatttccatatcccagccttaattttaggggaacatattgagcctcgccgtgataatcgtttggtcagccaaattgatatgccaacgacattgttatctgtcgcaggcattagtggcgattatccgatgattggctttgacttaactcaaaatgtcgatccaaatcgtgcgtttatgcagtacgaccaaacgcaagcaatgatgaaaggcaaagatgtgattattcttaagccaaatcaatctcctcaaggttatgaatatgataaagcgaatgaacgccttaacccaaaagagcagtctgaagcaatgaaaaaagaggcactggcccacgcattgttaggcagttatttatataaacatcagttatataaattgccgaaagatgttgaatagcaagtaatatttaatttttagtaaatataggtataaaaaattatgagtattcgtattttaccccaagaagaaattcaacaagctgcaagctcttttcacaatccgccgttgttgtatgccaatcctaaaaatttatatgctcgccgagctaaacgtttaagacaattggctgaacataatccttttggggattatttggaatttgtggcaaatattgtcgaggttcagcttgatttattagaaaatcagcctattgcaaatagagtgggcgaacttaccgcttatttggaagctcatcagggagtgaagcctttagatgtgaaaacctttaagcggtcagatgagtggcagaaattgctgttggcgtttattgataagtttaagccttatgcgtcggatactgtgttggcgacattggaatggttagagaaagcctcaaattctgagcttgaaatgctggcggatcatttgttgaatgagcgttatgaagaggtgggcgcagacaaggcggttttcttatgggcggtcttgtcgctttattgggtgcaattaactcagcaacttcctcgcaataccaaagcggagtacggtgaagaacgccatacttgccctgtgtgtaactctgccccgattgccagtgtggttcattttggggaaacgcaaggtttacgttatttgcactgttctctatgtgaaagcgagtggaatatggtgcgtgcgaagtgtagtaattgtgagcagacaggcaagctcgattactggagcttagacagtatggacgcagaggtgaaagcggaaagttgtggtgattgtgagagttatctgaaagtgatgtatcaagataaagatccgcatgttgagccaatcgccgatgatttaggtacgattttccttgatgctgaaatggagcaaaaagggctggcacgcagtgcgattaatccttttttgtttcaagtagaataatttttatacatatttattgactacatagcaactgtgtaagaatacagttgctataagtagaatctaggaagcgtggtgggtagcgtaaatttctaagcgttttcgtttttagggaacatcccccaacgcattttcatttttcgtgataaacattgcgtcaccgtagctaaagaaacggtattgactttcaacggcgtgttgataagcgttcatacagtttttgaagccggcaaaggcggaaaccaacataattagggtggattccggcaagtggaagttggtgactagggcatcaacgatacggaatgtttttcccgggtatagaaaaattgccgtgtctgaatagaatggggcgattaatttgccttctttttctgccgcttgtgctgcactttcgatagagcgaacagaggttgtgccaacgcagatcactcgtttgccttgtgctttggtggcaagaattttatcgaccacttcctgcgatacttcggcatattctgcgtgcattttatgttcttcaatggtttctactcgcactggttggaatgtgccagccccgacgtgtaaggtaacaaaggcggtttgtactcctttttcttgcagtttttgtagcatttgatgatcaaaatgcaagccagccgttggggctgcaactgcacctaacactttgctatataccgtttgataacgctcttgatcggcatcttcatcggggcgatcgatataaggcggtagtggcatatgtcctgcctgttgtagcagatcgaataaaggcggctgtgcttcttcaaatttcagctcaaataacgcatcgtgacgagccaccattatcgctttaaagccatttccttcgcctaatttatcttcccctagaaagatttcagcattctctttcggggcttttgatgaacggatatgagctaaacagcgatgttcgtctaatacacgttccaccaacacttctaacttaccgccactggctttgcgtccataaaggcgagctgggataacacgggtgttattaaaaatcagtaagtcaccactatggatatgttcaagtaaatcattgaattgttgatcttgatattcgcctgtattaccgttgagataaagtaaacggcttgcacttcgttcagccgttggatagcgagcgataagttcatcaggtaggtcaaaatggaaatcggttacacgcacaacagttccttaaaaaatagtagggacgccacgcttggcgtccataagtataatgagataaataaaaccgtgaatttatagtgaaatccaaccgcttgcaagcctaagattgcgattcttctacattaggcaaggcattgatcaccgctttgactaaagttgctaatggaatggcaaaaaataccccccagaagccccaaagaccgccgaaaataattacggcaacgatgatcgttaatgggtgtaaatttactgcttctgagaataaaaatggcacaacaaggttaccatctaaaagttggctaatcacaaaagcaagtagcaagtagtagaaatcaggggataagccaaattgaaagagtgcaactaacgcaacaggaattgtcactaataccgcaccaatataaggcactaataccgataaaccgaccgctactgagagtaacaatggatagcgtaaatcaaagaaaaggaaaataatataagttacaacgccaacaatgagaatttctaaaaatttcccacgaatatagttggcgatttgtaattgcatttccccccaaacacgagtagcaaggtggcggtttttaggcataaaacgtagtgcagaacgcataaacaacgttttatctttgagtaagaaaaagaccattaatggtactaaaaacgcataaatacctaatccgacaaggctaacaagggagttgaatgaaaacgacaataaggagtcgccaaaggtaagaattttagtttttgccgttgccattagggagtcgagcattgcatagtcaatcaattctggatagtgttctggcagagcctcaagccacgcattgagcaagttaaacatactcggcaggtcttttaggaaggtcactgcttggttccatagacttggaagcattaccacaaacaaaaagacagagagagaaataaatccgcctaagacaatcactaagctgagcattcttggtaatttgagtttggtggttagaaagcggataggccattctaaaaggtaagcaaaaacaatggcaatcaaaaggggcattaagagatcactgaaaaagtagatcgttccaaagccgataattaagatggcaagaagtgcgacaatttgtggatcagtaaatttctgtttataccaatccttgaacatttcaaacataatctatcctgtcgtgttttgcgtttatttattgttatgatgataaaaaaaaggggcgtttaatgtacctactatggatcactgacaaatatcaattaacaagataatgttgttttgttgtggtagggacacactgcgtgtgtccgtttttaaggtaaagataaaatatctcgtacccttaccacaatggacacgctcagcgtctccctacatttacctctttttcgttatttacattatttttgactacaaaccgcaataaagcctagttgattttcagggtcattaaaggtctggaacattttcttgaaagtatcacggttttccggttttaacgcattacccaccactttcattgcccctaaaaccccttcatcttgaattaacccttttggagataacaagctcatctcaccactaaaggtttcaacattgcggaagccacaatgaaggaatgtatctttccaatcctgcttatttaagggtgctacggtgatattaatcgcatcacgcaacttagcgatcacctcttcgctgttatcgccattgagcagtaaatcgtgggtaagtaataaaccgtttggctttaatactcgcagatattcacgaattgccttttctttggcttcttgcggtagcattgtcagcattgcttcgttgataataatgtcgaaactattatcttcaaatggcagtttggtggcatttgcacgttgaatttgcactaattcttcaactttatgctctttaatgttgtgttgtgctttttctagggcttcttcatcaagatcgataccgatcacttggcaaccaaattgttgagcaatttcgattgcggtccttcccatattacaagcaacttcaagcacttttttatctttccgaaaatcgccatttgcaatgagccagtccgttgccactttgccacctgggcgtaaacgtgttttacccaaacgagctaagaaatggtgtccaacttcttcttttttcatattcacctctttggattttgtaaaattctgcttaattcagaccgcttgcattgaaaagaagttcaatttaggctgaataacgccgtagattataccgtttttttatctgtgcatatatacaattaaacagaaatttggcaaaatttcgcacatatcttccaacaacactgaagatataccattcttgttttaacaaaaaggaaaaataatgaaaaaatcaacaaaatcagaatgctatgcccatcagcgtggcgaaattcaagagagtgcaattaaagccttggtgacggataaactgtttagaagtcgagtagagcaaaaccgcaaaggtaaaggaagttatcagcgtaacgcaaaacatcgcaaaggggaaaacccatttaaaagtgttcagcagaatgtttttaaatgggtttttcttatccagaattagggttgtttaatttggtattatgtagcagttgtataaatatcttaattttctgctacaattccgttatctttatttaggttaaataagaacaaagagacaaccatgcaaaacgaacccattcgcttaacacagtatagtcacggtgcaggctgcggctgtaaaatttccccgaaagtgcttgaacaaattctgcacacagaacaggcgaagtttattgacccgaatttgttagtcggtaatgaaaccaaagatgacgcggctgtctatgatatcggcaacggtgttggtattgtcagcacgacggatttctttatgccgattgtggacgatccttttgatttcgggcgaattgctgcgactaatgcaatcagtgatatttttgcaatgggcggtaagccaattatggcgattgcaattttaggttttccaatcaataagttacccgctgaagttgcacaaaaaattgttgatggcggtcgttttgcgtgccaacaagcaggcattgcgttagctggtggacactcaattgactcccctgaacctatttttggtttagcggttacaggaattatttctaccgaacaagtgaaaaagaacgcatcagcacaagccgattgcgatttatatctaacaaaaccacttgggatcggcgtacttaccacagcagaaaaacaaggtaaattaaaacctgaacatcaaaatttagctcgagatgtgatgtgtcagatgaatttgatcggtgctgaatttgccaaagttgatgagatcacgacaatgaccgatgtcactggtttcgggttactcggacacttaacagaaatctgccaaggttcaaacttgcgtgccgaagtttatttcgatcaaatccaaaccttagacggtgtcagagagtacatcgcacaaggtgctgtgccaggcggaactacccgtaatttcgacagctacggacatctgatttcgccattaagtgatgaacaaaaagcgattttgtgcgacccacaaacatcaggcggtttattaattgccgttaagccacaagcggtcgaaagcgtgaaacaaattgcaaaaaatgccaatgtcgccctttaccctgtcggcagattattgaaagcggaaagtggtaaggtattgatcgacgtgaaatagtagggacacactgcgtgtgtccctacattaaattttgagaataaataagatatgaaacaaaacattgatgtggtaattgtcggcggtgcggtgacgggttctgtacttgccttagcgttaagttcagtaagcggacaccaattgcaaattgcaatcgtagaaaaaaatgagccaaactatgcacaacaaggcggttttgacgcacgttcaatcgcctttgcttacggcagtttgcaaaagttagctcaaattcgaccgcttgccacggaacaaaatttagctcaactggtttaccgtattgcaacccccatcaaacaaattcacgtttcagatcaaggacatttcggcaaaacaaccttaaaagccgacgaactacgtttatccgaattaggtgtggtagtggaattaaccaaactgggcgagcaactgaccgcattaatcgccaaactacccaacattcagctattctgccctgataccgtcgcccatatcgaacgcacagaacagcactgccacattaccctaaacagcggaacacaattaacgtccaaattgttagttgcctgtgacggcattcaatctcaaattgcccagcaatgtggcgtaacaatccaatttatcaaggattatcaacaatccgccattattgccaatgttatcctgtctgaaccacaccaaaaccacgcctttgaacgtttcacaaaacaggggccttttgcattattaccacttaatgaaaaaatgatgtcgctggtttggtgtatggaagatccgacagaagcaatggcaatgtcagacagcgactttttacacgccttgcaacaacaattcggctggaagctcggcaaatttttacaagtcagcaagcggtttgtttatcccctttcttcacaaaaaagcgaaagccatattcaccaccgactagccattgtcggcaatgcctcccagttactacaccctgtcgcaggacaagggttcaatcttggaatgcgagatctatttgaattggcaacccttgtcggtcaagcctttgcacaaggcgaagatttcggcgaagcaaaatggctacaacagtttgaacaacaccgccaagccgaccaaacccgaattatgcaaagcacaagcggtctgattttgatttttggttgcgaatttttgcctattcaagtcgctcgtaaccttgccctatttggtttatctcatttttcactggctcgcaatgccgttgctcataaagcattaggctggtaattttcggtatatgtttaatcaacttcaacatcagttacacaaattcgtacaacgtggtttagataatcatctacgccttgccgtgacaggcttaagtcgcagtggtaaaactgcattcatcaccagttttgtcgatcaactgctacacattggcacaggcgacaacgcccacttaaacctatttgcccctgctcgaaacggacaaattctttccgtaaaacgagtagaacaacacgatctcaccattccccgttttgaatacgacaaaaaccgccactgcttcgagaacgaacctgcgacttggtgtccatcgactacggggatcagcgaaattcgccttgcgatccgctaccaacgccgagatagcctgcttcgccatctcaaagaaacgagtacactctatctcgatatttttgattacccaggggaatggttattagatttaccgctactctcacaaagtttcaaagagtggtcgcaacatcaacaactggtacataaaggcgagcgtgcagagttagtacaggcttggcttgcacaagtaaaacaactcgatctcaccgccaaaacggacgaaaaccaacttgcaaaattaagtgaagattacaccgcttacctactcaaatgcaaagaagttggaatgcaatatattcaaccagggcgatttgtcctgccaaataccgaacggggtgcgcctgtctatcagttcttccccctgcttgatttaacggaaaatgagtgggaacagctagaaaaaagtcctgaacatagcatttttcacaccctgaaaaaacgctatcgccactatcaacaaaaaatcgtcaaaccattttatgaagattacttctcacagtttgatcgccaagtgatcttagcggattgccttaccccgttaaatcacagccatcaagcctttattgaaatgaaaacaggcttacaacagctatttaaacatttccattatggcaaccgctcgctttttagtcgcctattttcatcgaatatcgacaagttactgttcgttgctaccaaagccgatcatatcaccagcgaccaactaccgaatttagaaagcctaatgcgacaattagtgcaagaaggggggcgacacgctgaatttgaaggcattgacacaggctaccaagcgatttccgctatccgagcgaccgatccagtgatcgccacacaaaatggacaaagtttcaaagcgatccgtgggattcgctctagtgataaaaaactggttacactctaccctggtagcgtcccaaaccgcttacccgacatcaactactggcaaaatcaccgctttgagtttgaccagtttgaaccgaaaaaaatcgactttgatcagccaatcccccatttaagaatggatgctgtattgcaatttttgcttgcagataggtttgattgataaattcccaacagaatagtgttagtaagcaaatgtaatataaaaaatttgggcatttgctacataataggctggatttaaggtacaatctcattaattttcttaataaaaaatagcactatgagtaaaaaaccaaaagtagcttcaaatacgattgccttaaataaacgtgccagacacgaatattttatcgaagaagaaatcgaagctggtctagaattacaaggctgggaagtcaaatccctgcgagcaggtaaagccaatatcggcgatagctatgtgacatttcgcaacggcgaagcctttttattcggtggcactattaccccgttaaatgttgcttctacccatattgtatgcgatccaacccgtacccgtaagttattgttaaataagcgtgagttagacacgctttatggtaaagtcagccgtgatgggtttaccgttgtcgctctgtcgctttactggaaaaatgcgtgggcgaaagtcaaaatcggcttggcgaaagggaaaaaattgcacgataagcgtgaagatattaaagaccgtgagtggcaagttgctaaacagcggattatgaagaatgcgaataggtaggaaatatcccctagtccccctttttcaaaggggggaatgttaaggaatatttatggaaccttatctattccaacttaaaccaaatgcaagaacattacgcaatacgatgacaaaggcagagcatatcttatggtctagattgcgtagaaaacaacttttagatctacaattttaccgtcaaaagccaattttaacttatattgttgatttttattgcccaaaagcaaaacttgtaattgaacttgatggtagccaacattatgaagtagagcatatagaagcagataaaataagagatcaggcattaaactcactaggattgtatgtattgcgtttcaataatagggaagttatttctagtattgaaaatgtgattacacatattactcaaattatcaaaaaacgaatataaaaccaattaacctttttcttagttcccccctttgaaaaaggggggctaggggggattttataaggacacaaaaatgatcgaccaaaaccttctacgtacgaaccttgaggaagtcgcacaaattttaaaactcaaacgtaacttcaaccttgatgttactcgcgttactagccttgaagaacaacgcaaagcattgcaagttaaagcagaaaatttacaggcagaacgtaatgctcgttcaaaaaatatcggcgcagcgaaagcgcgtggcgaagatatttctgcattattagcagaagtggacacgatgggtaacgaattagatgcagcaaaagtggaattggataaagtccaagcggaaattcgtgaactgttattaagcattcctaacttacctgtcgatgaagtgccagtgggtaaagatgatagcgaaaatcttgaagtatctcgttggggtacgccacgtcaatttgactttgaaatcaaagatcacgttacccttggtgaaggcttaggcggtttggatttccctgctggtgtgaaattaactggaagccgtttcgtcgttatgaaaagtggtattgcacgtttacaccgtgccttatctcaatttatgttagatttacacacagaacaacacggctatgtggaaacctatgtgccttatcttgtaaaccacgataccctttacggcacaggacaattaccaaaattcggcgaagatctgttccatactcaaccgttagaaggacaagatccaaatgcggtacaaaaaccttacgctttaatcccaaccgcagaagtgccagtcactaatcttgtgcgtgatgaaatcttagacgaagaaagtttaccactgaaactgaccgctcacaccccgtgcttccgttcagaagcaggctcttacggtcgtgatacccgtggcttaattcgtatgcaccagttcgataaagtagaaatggtacaaatcgtcgcccctgaaaaatcaatggaagcccttgaagaattaacaggacacgcagaaaaagtgttgcagttgctcaatctgccataccgcaaaatgttactctgctctggcgatatgagctttggttcaagcaaaacctacgatttagaagtgtggctaccggcacaaaatacctaccgtgaaatttcatcttgctcaaatatgtgggatttccaagctcgccgtatgcaagcacgttgcaaagcgaaaggggataagaaaactcgtttagttcataccctaaatggctcaggtttagctgttggacgtacgcttgttgccgtgcttgaaaactaccaaaatgcagatggttcaattactgtgcctgaagtgttgaaaccgtatatgggtggtgtagaggttattaaataatccctacaagcgatctctttttatcaatttattaccaaagtaggggcggaccgatgtgtccgcccttgtttcgtattgtttaggaggagatatcactctgctcctatgaagtaacttagagctattatttcactatagtagataattgattttcaaattaagcatttatctaattttattttttgaggtaatcaatggcagcagaaggtgcaagtcaattagttagtgtagtgacccttttaggggcggcaattattgcggtacctatttttaaacgtttgggcttaggctctgttttgggatatttagctgcagggcttgcgataggtccttttggtttaaaacttttctcagatccccaagcgatcattcacgttgccgaattaggtgtcgtgatgtttctgtttatcattgggttagagatgaaaccatctcacttatggggctgctcgtcaaattttcggcttaggcagtatgcaagtggtcgtttgtgcggtcttgcttacgtttgttggtatggctttcggctattcttggcaaatctcttttgttggtggggcgggctttgttttaacatctactgcaattgtaatgcaagtgttgagcgaacgaggcgatattgctagtcctcgtggtcagcgaatggtgtcaatcttgctttttgaagatctgattattgtgcctctactagccattgtcacctttcttgcaccgacagatccaaatcatattgccgatccccaacctatttggcagaaaatcggtatcgcagggttatctgtgaccgcattggtggtggtcggtatttgggtactcaacccgattttccgtattctagcaaaaaccaaaatccgtgaattaatgacggcagccgcactatttgtggttttaggctctgcgttattaatggaagaaggtggattatcaacagcaatgggtgcttttgtcgcaggggttttactctccgaatcaagtttccgtcaccaattagaggccgatattgagccatttagagggttattacttggcttattcttcttaggtgtgggaatggcattagatctaaacattgtgtttgataactgggttctaatcctttcggcagtgattgcaatgatggcagtgaaatcattgtgtattttattaatagccaaacttgctaaaagtagcaccagcgatgcaatggatagagctgttgtgatggctcaaggtggtgaatttgcctttgtactatatgcagcatcgacaacacaaggggtaatttctgcagaaattcaagcaaatctaaccgctattgttgtattttcaatgatttttgccccaatcaccatcattttacataacaaattcgtagcacctcgttttgcaaacaaagctggggaacgtgaagccgctcatattgaagaacagcacccgattatcttagttgggattgggcgttatggacaaatcgtcaatcatatcctcacgatgtctggctatcaccctactattattgatcttaacgaagcgcaaatcgaaggggcgaaaaagtacggaattaaaagctattatggcaatgctactcgtccagaattacttcacaatgcagggattgaaactgcggaattattaatcgttgcggtagatgataaacatcaagcgatacatattgtggagctggctcgttctatgaacccgaatatcaaaattatcgcaagggcatacgatcgagttcatgtctttgaactttacaaagcaggagcagataaacaagtgcgtgagacctttgattctgccttacgcagtggacgtgcggccttaaaaatgctaggtgttgaggaagaagttgctgatgaaatttgtgactactattttgaacgagatcgccataatgtgaaattaatggcggaagtctatgatcctaatttagaactctttaagaatgaagaaatgcgaaaaattgcactagctgaagatcaggaaacaatgctcgaaattcagaatattttggacagagcaagggagaaaaaagaagctgggttctttaattccccgcactaaataagaaaaggttctgaagatagtttttctgtgtaagacagtaaataattgctctaaagagcaagtttcatcgtaaagattaaacctaatctgccagttctataattacagctcctgccagattaggcatgcttctacggttctgatcaacaagcggttatttatttaacaccgcttgcaacgctaccccaatgtcagccaaactacgcacagtttttacgcctgcggcttcaagagctgcaaatttttcatctgcagtgccttttccgccagagataatcgcccctgcgtgtcccatacgttttccttttggtgcggtaacgccagcaatatagctcaccacaggtttagtcacgttcgctttgataaaggctgctgcttcttcttctgcggaaccaccaatttcaccgatcattataatcgcttcagtttcggggtcagcttggaatagtgttagaatatcaatgaagtttgaacctggaatagggtcgccaccgatcccaacacaagtcgattgaccaaaaccgtagtctgttgtttgtttaactgcttcataagtcaatgttcctgaacgagaaacaatcccgattttaccttttttatgaatgctgcctggcataatcccgattttgcactcatttggggtaatcacgccagggcagttagggccgatcattctcacgcctgtttggtttaaacgctgtttcacttgaagcatatctaaggttgggataccttctgtgatacaaacgacaagctgaatacctgcatcaatggcttctaaaatagcatctttacaacccggtgctggtacataaataaccgttgctgtcgcccctgtagcttccactgcttcacgcacggtattaaatactggtaaacccaagtgcgttgtgccacctttgcctggtgaaacaccgccgacaagttgtgtgccataatcaagggcttgttgtgaatggaatgtgccttgtccgcctgtaaaaccttggcagattactttggtatctttgttgattaaaatagacattatttaccccctgccgcttttactgcttctacagccgcatctgttaaggttgctgctgcaatgatatttaagccacttttcgctaaaatttcacgtccaagttctgcgttgtttccttctaggcgaacgacaacaggtacgtttacccctacttcattaacggctgcgataatcccgtcagcgattaagtcacaacggacgataccgccgaaaatattgacgagaacagctttcactgctttgtcagacaagatgattttaaatgcttccgcaactcgctctttggttgcaccaccacctacatctaagaagtttgctgggaaaccgccgtgtaatttgacgatatccattgttcccattgcaagtccagcaccgtttaccatacaaccgatgttaccatctaaggcaacatagttaagttggtgcgactcggcaagggcttcacgcgggtcatcttggctaggatcgtgcattgcggcaagttcaggctggcgatataacgcattaccatctaccaccattttggcatctaagcaaagtaaattgccttcagtggtaacgacaagtgggttgatttcgagtaaggaaagatctttttctacaaagagtttagcctgctgtgtgaagataaaactaaattgtttgatttgatcgcctgttaaaccaagtttaaacgctagttcacgcccttgatatgccattccacctacaagcggatcgatagcgactttatgtagcaattcaggggttttagccgcaacttcttcgatattcattcccccagcacttgaagccataaaaacgactttttgtgatgagcggtcaattactgcccctaaataaagttcacgggcaatccctgctgtttcctcaacatatagggtattaacaggctgaccatttgcgtctgtttggaaagtcactaagcgtttaccgagccatttgtctgcaaattcacgcacttctgcttcatttcgtaccagtttgacaccgccagctttaccacgaccgcctgcgtggacttggcacttaattgcccaagcatcgcctttgagttgtttgattgcttcaaccgcttcatctgccgttttacaagcaatgccttggctgacaggaagtttatatttggcaaagatctgtttgccttggtattcgtgtaggttcatagagttggggttcctatgtgattaaaactgttttcccccctttttcaaagggggaaatgttcattctaaatttctaacaacaaacgtgttggatcttcgagtaaatctttgatggctactaagaaaccaacagactctcgcccatcaatcaaacggtgatcatagcttagtgcaagatacatcatcggacgaataaccacctgaccgtctacagccacagggcgatctttaatagcgtgcatacctaaaatagcactttgcggtggattgataatcggcgtggacattaatgaaccaaagacaccgccattagtgatagtgaagtttccacctgttaagtcttctacagtcaatttaccatcgcgtcctttttctgccagtgctttaatagctttttcaatgtctgccattgaaagtttgtcgcaatcgcgtaacacaggggtaactaaaccacgaggggtagaaacagcgatactgacatcaaaatagttgtgatacaccacatcatcgccatcaatagaagcattcacctctggataacgttttaatgcttcaaccaccgctttgatatagaacgacataaagcctaaacgcacaccgtgttgtttttcaaatttttcaccgtattgcttacgcagatccataatcggcttcatatctacttcattgaatgtggtgagcatcgccgtagtatttttcgcttctaataaacgctctgcaatgcgtttacgcaagcgggtcattggcacacgtttttcactacgagcagagtaagccactgtgctgatagtattttcaactttctcagccactttcgcattacgtttagccacaaccgcttcaatatcttcacgagtaattctgccacctacacctgaacctttcacctcactagcttctaaaccgtgttctgcaagtaaacggcgaacacttgggcctaatgcgtcagccgagctattatctggctctaaagaggcggtttgacgatctgaaggggttgcttcatttactggtttaattgtcgctaaagacacatcacctgcttgctgagtaactaaaatacctaaaacttgtttacttacaacagttgccccttcgcctttttgaatttcggtaatcacaccatcgctagtcgcaggcacttcgagaaccactttatcggtttcaatttctacaataacttcatcacgttttatgctatcgccaacttttttatgccaagttgcaacggtcgcatctgcaacggattcgggtaaatctggaacgaggatttcgattgtcatttgttgtttccttctatttaaattctcattcccccctttgaaaaaggggggctaggggggatttttataagctaatgctgatattgagatcgttaaatcccccttaatccccctttttcaaagggggaaattacatcaattaaacgcttaatgcctcatcaaccaactgtgtctgctgtttggtatgaagtgacatatatcccaccgctggtgaagcggaagctgggcgacctgcatatttcaatgtcgcattctctggaatagaggcttcgaagttgtgtttgctacaataccaaaccccttgatttaatggctcttcttgacaccaaacataatcagtaacatgagtataaggcataagtgcttttttcacatcttcatgtggataagggtaaagttgttcaatacgaataatcgctacatcggttttcacacgctggcgacgttcttctagtaaatcgtaatagactttacctgaacaaagtaccacacgcttaacctgtgcaggatcgagattatctaattccccgatcaccgttttaaactcaccgttgatcaactcatctaaagttgaaacagcaagcgggtggcgtagcagtgattttggcgaaatcgcaatcagtggacgacgcattttacggatcgcttgacgacgcaacatatggtaaacctgtgctggtgttgatggaatacagacttgcatattttgttctgcacaaagttgtaagtaacgttccaaacgagctgatgagtgttcaggaccttgaccttcatagccgtgtggcagtagcatcactaaaccgcacatacgtccccatttttgttcaccagaactaataaactggtcgataacaatctgagcaccgttcgcaaagtcaccaaactgagcttcccaaatcgtcaatgtttttggatcggtcgttgcataaccatattcaaatgccagtaccgcttcttcggaaagtaccgagtcccacacctcaaaacgcccttggtttgcgtgcaaatgcgttaaaggcacatagcctgtaccatcattttgattatgcacaacagcgtgacggtggaagaaggtaccacgaccagcatcttcacccgatagacgaacgtgagtaccatcatcaagcagggttgcataagccatcgtttcagccataccccagtcaagcagtttattgccttgatacatctcacggcggtcgttataaattttttcaacacgagggtgtgggcgtaacgcttctggatattcgcacacacgtttcgcgatttctaagaaacgagcttcagggaatttgctttcatacggcgacgtccattcataattaagatattgcaaccaatccattgacgcagtatccatttctcgccattcaggcacaacacgatcaccattatctaacgcatcacgatagaggttcatcatctcaatttcatcatcacctgtaatcaccccttcagcaatcaaacgatccgcataaactttacgaggtgtcgggtgtttcttaataataccgtacatcatcggctgagtagccaaaggttcatcagcctcattatgaccgtgacgacgataagaaattaaatcaataaaaatatcacgtttaaataaacaacgatattccaccgccattctcgctgcaaatgccaccgcttcaggatcatcaccattaacgtgaataatcggggcttggatcatcttggcaatatcggtacagtattccgtagaacgggtatcgtttggattagaagtcgtaaaaccgatctggttattgatcacgatacggattgttccgcctactttgtaacctctcgcatttgacatattcaaggtttcttgaacaaccccttgacctgccactgccgagtcgccgtgaaccgtgatcgccaatactttcttatgttcagtatcgtgaatacgagtctgtcttgcacgcacagaaccaatcaccacagggctaacaatttccaagtgtgaagggttaaatgcaagagcaaggtgaacgtgtttaccgtccacatcaaaatcagacgagaaaccctgatggtatttcacatcacctgtacgattatcatcagcgtgtttaccagcaaactcatcaaaaagttcagcaggtttcttacctaacacattgactaacatattcaaacgaccacggtgggccattcccatcactacattttccataccttgacgaccagcgtgacggataatctctttcatcatcggaataaaagcatcagacccctcaagagagaaacgttttgccccagggaatttcgcccctaaataacgctccaaaccatcagcagcggtcagttccgttaataaatttactttttgttctttagtgaacaacggcttattcagcacactttccattttcgcctgaagccaatttttctgctccatatcctgaatgtgcataaattccaaaccgatactaccgcaataggtttcttttaacgcctcagcaagttcacccagcttcatcgtatctttgttataaacataacgcccgatagtaaaagtttcttctaaatctttatcactgaaaccgtggtaacggtaatcgagttcaggaacctgtgaggttttccaacgataataattaagcggatctaatttagcttccaaatgtccacggaagcggtaggcattaatgaactgtaacactttaacgagttttgcactggcttcaggatcaataactgtcaccgcctcactacgattttcacgtgctaaacgacggaaataatcacgaacgctggaatgaggttgctctacttgggtagcttttggcagttgagcaaataccgcttgccaacttgcatcaacgctatcaggatcttctagatactgctcgtagatttcctcaacataagactgatttgccccacctaatgcagtagtcgcaatccaatcgtcaaagtttttatgttgcataaagacctaaccttatttttatctgtttacaaagttgttaaatttgctgtcattatatacatttcagtacaaataaaggcaaaaaagtcaaagagaaatgcttacttataaatcagtcacacaaatccccccaattatgacggattttttaaagaaaaactgtgatataagtcgaatttttacaaaaaattaacattgtaaagaagggaatttgatggtagaagatagaaagaaaggaaatgcctcttattcaataagtttgacagcatacactattaaactaaatgcaatgccatacataattaaccctgtgacaaaatctaaaatctgccaagttcgacgtttttcaaagtaaggggaaagcaagccggctccataacctaccccaaaaaaccacaaaaatgaacaaattaatgctccgatcaagaaatgtattttttctgcgaaacttaaagtgccaccgataccgccgacaatcaccacagtgtcaatataaacgtgtggattaagtaatgtaatcgcaagggtaatggcgatcactttctttaaagacgacttagcttgcccttgttgtgccaatagctgacttgagccttgataagcagtgataaaagagcgactaccataagtgaataaaaaaatcgcaccaaacagagcaagcaataaactagcggtaggtgactgcgaaataagcgaaccaagccccaatacaccgatactcatcaacgcaacatcacaaagaaagcagagtagagctacccaaaaaacgtgctgttttaaaatcccctgcttcaataaaaatgcattttgtgcaccaatagacacaatcagcccaaaacagaccacaaaaccgtgtaaaaaactttccatcacttaatttctccctcatacaggcggacgattatacccaaatatttcatatatttgtcgaggttattcgttaaattttgtgtggggctatgtcagacactaatttattggaggaaggtataaatgagcacagatagaaattctccatttttattcaatagtagaatggagaatttccaaatgtctagagagtgtatcttagtctattagttataaagtcattttataactaacaacttactcgcattactcatcatatccgctactttcggctgagaagataattgcgtttcgttcattggttcaattttccaaatatctttcgcataatctaacacagagcggtctgatgagaagtagcccatattcgcaatgttgatgatcgcagaacgtgtccacgctttcttattacggaagtaggttgctactttctcttgagcatctacatagctacggaaatccgcacaggcttgatagaagtcacctgatgagagaattaactcttgataacgatatggatcttctggtgagaatttaccatttaagatttgtgaaattgcttcgtttaattctgcatctttttcgtagtagtgatatggtgagtagccgttgcgacgtaactcttccacttgttctacggtgttaccgaagataaagatgttgtcgttacctacacgatctaaaatttccacgtttgcaccgtcaagggtaccgattgtcaatgcaccgtttagggcaaatttcatatttgatgtacctgatgcttctgtaccagcaagggaaatttgctcagacacatctgctgctggaataattaattgtgcaaggcttacgctgtagttcggaataaagacaactttgattaaatcacgaatatggctgtcgttgttgatcacatttgcaacatcgttgattaaacgaatcacttttttcgctgcatagtaagcacttgctgctttacctgcaaagataaagacgcgtggctgccaatctgctgttgggtttcttaaaatacggttatagtgagcaatgatgtgtaacacatttaattgctgacgtttgtatttgtgaatacgtttaatttgaacgtcaaaaatcgcttcagggttgagtttaatgccttgagtttgttctacataagcggcgagtttacgtttattttctactttaaccgcagccacttctagttgaacatcagtatcatcaacaaaggcattgaacttgtctaactgagttaaatcggtacgccattctttgccaatgcgtttatctaaaattgcagcaagtccaggattagcgatatgaatccagcgacgtggggttacaccatttgttacgttggtgaagcgatctgggtagatcttcgcaaaatcggcaaaaatagactccaccattaagtctgagtgaattttggctacgccattgactttgcctgatgcaatcacggctaaccacgccatacgaatacgacggtcgccttgttcgtcaataatagatacacgacggattaattcttcgtcatttgggaattgctgacgaacctcttgtaagaaccaatcgttgatttcaaaaataatttgtaaatgacgtggtaagatacgagccaccatctccacaggccaagtttctaacgcttcgctcattaaagtgtggttggtgtagaagaatactttgcgagtcgtattccatgcctgttcccaactataacctttttcgtcaattaaaatgcgcattaactcaggaatcgcaagggtagggtgggtgtcgttaaggtggattgccactttttccgcaagatttaagcaagatcccgattccacttcatgacgacgaacgatgtcttgtactgatgcagagcaaaggaaatattcttggcgtaaacgtaattcacgaccgttgtaagttgaatcgtctgggtaaagtacacgagaaacgttttctgagctattttgttggctcattgctgcaaaatagtcaccacggttaaagtctgctaaaccaaatagtttttcccctgcgtgtgcagaccatagacgtaagctgttggttgcagtggttttaaatcctgggacaagctggtcgtgggcttgagcaatgatttcttcatcaggttgccatacggtttttttgccttcttgccaagttctgccaccaaaacgtacagggaattttttacttgaacgtaagtaaggccacgcaaattcattttctaaccaataatctggattttcaacttgttcgccattttttatctcttggcggaacataccgtattcataacgaataccgtagccaatcgcagggatcttcattgctgcaagactgtccatataacacgcagccaagcgacctaagccgccgttacctaagcctggatcgccttcttcattaataatgtcttcaagattttgacctagctcgtcaaacgcagctcgaattagatcataaacaccttctgcaatcatagcattactgaaggttcttcccattaaaaattccatagaaagataataaacacgacggcttgtatttgccgcttggctacgacgagtttgtaaccaagattccgtagaaagatcacgcacaacacgcaatgccgcatttaaccagttacgtttgcttgcttcacgcggttctacaccaagagcaaaaacaagtttatgcaaaatggcatttttgacattttgaatgttctcagggctaagatgtgtgtttgactgagcgatagtcattcattactcctattaaataaaacgatagaaagaataaaaaaacgacgcattttacaatacttttgtgaagtttcttaccaaattacgaaaaattgcgcttacttactgaactatactgttgaaaaagtagaaacagcgaagtaatgtttgatttttcttaaattttcattagaatacgcactcggttttttaaccgtcaaatttagggaaatagctgggtcgcctgctatttttgtatcaatggaaccttaggttccctttttatttatgagaatttaattatgtcattcaaatttgaagctgaagttcgttcggcgcaaggtaagggtgcgagccgccgcctgcgtcacaatggtcaagttcctgcaatcatctacggtggtaaagcagaagctgtatcaatcattttagaccacgataaagtaaacaacgcacaagtacacgatgcgttctacaacgaagtgttaactatcgttgttgcgggtaaagaagagcaagtaaaagtacaagcgattcaacgtcacccaactaaaccaaaacttgttcacttagactttaaacgtatttaaccccatgtagttaaacactatttctcagactttgtatctgttagttttttaatttaaagtcagattactacgagatagtttaggaataaatttcaagtagttccaagccccttttatcagcggataaaggggcttttaactataataaataggggctagataactaacttaaaccgtccttaactaattatgtttaaatggaaatttgagctttaagttactgtgattaaaacgctatttgcattccttcaaatacaattccaaatgtactttggaaatactgttaaacttgagtaaatgacgtttatcttggctctaaaaatgctcaattctgtttatatggttttgtttttctatggagtggtataactcagtgccacagtcaatgaatgctttgccgttgaagattctgtattaggtatgatttcaggcaaagcagcgaatatgaaaactgtcgttattcctgctaaggcagagtgggatgatccacgttggtcgttggcagattataagttagagcagatttctgacttgctaggattaataaaatcatcataaatttgatatagattgtattttcatttgaaaaaccgcagaaaagcggtttttcctatttattctgattgtttaatgataagattgttcgaatttcaatctttgttatgtgtttgtgtggtgagtgaaggagatgttatgaagaaagttcgtagatattcagaagcaacattagtgtcactacttgtgactgcttgtggtggtggagataattcctcaaatatgacacctattaatagcggttcagaaaaaatagatgaaacatcgatttcttcacctatattggtggaatcagagaatacaaaatctgattctattatttcagaattaaaagatccttctgtaccagaagctccgaagcaagatgaaacggtatccgaagtacccgttacaccaaatgatgaaaaagtcgaagaaaccgtaaccccatcaactgagcctactgtaccagaagcgccgaagtcagatgaaactgcttctgagacacctgttacaccaagtaatgaaaatgttgatgtaacagtaaatccatcacctgaacctactacgccagaagcgccgaagtcagatgaaacagcatcggatacacctgttatatcaagtgaagaaaaggacgaagagccagctgatacaacgactaaaactacggaatctccaaatgttgatgtttcaatgacatcaatagtcagtgatcatattttaccgccaaattatcaacctaaagatccttctagattatttgatgaagcagataaatttgctagccgtaatggattaatcgaaaagttacgtcctcaacaacaagcgacaataagtgatgaatatagtgttcaaaagattggcgttattgatacggatttcgtcaaagatgataaaacttttggaaatcgtttacttctaaatcaaggtctatggaggcaagctaaggggcaaaaacatgatcacgggtcgcaagttgctgcggtcattgctaagtataactcgacatcttggatttatggctatactgcagaatcatcaggaatgacgagcccgagtaatttgcattttgaagcggctcaagaacggggaataaaaatcttcaacaattcttatggtacggcacctagcaatgatttggtgaaagagaaggggtggaagtatttgacggatcacaggttacacaaacaaattgcagaaatggctgaaaatggcagcatctttgtttgggcagtaggtaatgaggggcagttaaaaggatatggcgctcaagcggttacggaagctcatattcctgtggcatataagcaggcgaaaaaaggctggattgccgttgcttcaattacaggacaatggaaaagtccctattcgagcagagtaggagaagatgcaaaaaattggggaattgcaacttatggtgatcatcaggtatttggtgataggcatgtacaaggcacttcttttgctgcaccagttgtctctgcagcggttgctaaggtttgggaaaaattcccttggatggataaccatttggttactcaaaccattctttctacggctgatcagttaggtacttcaaatgtgactatcgggcctaataaagatatcggttggggtgtgcttaaccttgagcgagcattaaaaggtcctgcacgttttgataaacggctattagtcgaaggtgaggagtttgtcgttgcgaagttcgatcatcgaaattatgccgatcaagatcgcctaacttggagtaacaatattgcaggagatgctggctttaagaagcaaggcactggctcgctttatttgacaggatataatacttatacaggcgatactgttattgatggcggtgttttagggttgtctggcaagttagacaattccaacgtgacaattaatacaagcggtacgttacttgcaaaaaataacgaaaaaccagtagaaataggtcaatccgttactaacaatggctcacttgatgtctatggcaaagggctaagtattggtggtaattatacggcggataaagatgctcgtactgtcattgatattcatacagcattgcttgaaattaaaggcactgccgatatgcaaaattctcgaattttagcggatgtggagaaaatcaatgatgtaccaacgcaaagtgagagtctaagaaccattttaaaagcaggtaatttagtcaattacaataatttttatacagtatctgatcacattgcaccttatattttagtcagtaagatagaaaaacaaggtaacgagatccaagcaacatataaacgtaatcaaactgcaaatgtattgcgaagtgttggtacagtttctcgtagtgcagaaaatacaagtacaaacttagataaagtgcttgatgaagtggctgcaaatccaacgagttcgattaaagcagatagtgtatctattattaatgcgaagcctatgtcagttgcaagtaccgtagagtctttatcggctgaaatttacgcatcatcacaaaatatgatcgtcaatgaaaatcgacttttcagtcaaaacattgcagagagagcattccgctcgtttcaagatgagaaaagtgatgtatatgcagtaacaaaccgccaatcttatcgaatttcgcaaaatggttatgcgaatgctgaaattggaggcaatcaaagttatgttggtgcagataagcaaacagagcatctattatttggcatctctgtataccatagcagacaaaaagccgatttcgagcgcacagcaggatctgcaaaattgcatcagcaaggtggtgcgatttatgcgggttaccaattagacaataactatttgctagctcagcttggaatggcaaatgcgaaaaacaagattaagcgttcaattttaatgccaaatgaaacacgccgtgtcgaaacagaggttaaatcaaagctttatcatttctatacggaattaggacatcgtattaaatttgaacaaggtgaaataagtccgtttatcggataccaatttgattctgtttatcaaaaagcctttgacgaagggaaaaattttggtattcaagcaaatcgtactcaatataacttaaatagttatttgctagggttacgagccacaatgaaatggggagatttacgcttaaatacgaccttatctcaccgtatgacaccaaaagcagaaaatgcgtttggctttaatgctcgctatatcggtgcggaaagtgaaattgaattacagggtatttcacctgcaaaatatgccactatggcgaagttgggattgaattatcaaattagcaaagctcttcatcttttcggggaatatgcgattgctcgccaaaaaggtggggaaaaatggcaaaacgtgagtgtaggaatgaagtatcagttttagtcactttttgcaaaaaatcaggcaaaagtagccgcttgtatatcatttgcttgtgaaataagcctttttggactattatcacaggcaattacattgctgttacaagcaataagacagacaatttaggggcgtatcttacgccccattatttatttaagagaaaaaacaatggcaagagaattttcaagatcagatcgtgtagcacaagagctacaaaaagagatcgcaattattttacaacgtgaagtgaaagacccacgtattggcatggtaacagtatcagatgtggaaatcagccgtgatttagcctatgccaaagtgtttgtgactttcctatttgatagcgatgaaagtgcagttgaacgtggcttggaaggcttaaataaagcatctggctatattcgtaccttagtgggtaaagcgatgcgtttacgcatcgtgcctgaacttcgtttcgtttacgatcaatccttagtggaagggatgcgtatgtcaaaccttgtgacaaatgtgatccgtaaagatcaagaacgctacgttgaagaagagtaacaatgggcagaccaaagaaaaaaggacgtgatgttcacggtgttttcttattggataagtcgcaaggcgtgagttctaacgacattatgcagaaggtaaaacgcctgtttaatgcgaataaggcagggcatacgggggcgttagatccgcttgctacgggtatgttgccgatctgtttaggtgaggcgaccaagttttctcagtttttgttagatgcggataagcgttatcgggtgatcgcaaaattgggggagcggacggatacttctgatgctgatgggcaagtggtgcagacgcgtgaagtgaaggtcgaaattgtagatattttggcggcacttgaggcatttcgtggtgacattttgcaagtgccgacgatgttttctgccttaaaacataatggtaagccgttatatgaatatgctcgagctggtattactgtggagcgtgaggctcgcccgattacgatttttgagctgttatttgttgagtatcaagcaccttatttgacattggaagtgcattgttctaagggaacttatattcggacgttagttgatgatctgggtgaggcgttgggttgtggcgctcacgttacgatgttgcgtcgtttggcggttgctgattatcctgttgagaagatgatgacattgggcgatttgcaaaatttagcggaaaatcagccgcttgttgagttagatcagttgttgttgccgatggatagtgcggtggctcgtttgcctcatttggatttaactgatgaacagacaaaagcagtgggttttgggcaacgtgtgaaatttgataatctgaagggaatttatggacaagtacggttgttttcagcagaaaagctgtttttaggcgttgctgaaattaccgcggataatgtgattagaccaagtagaatggtcaatagataaagtaagatgataaagagatcctatttaaccatatcaatggcgtgcttggtgttggcagggtgtgctaattctgagcaagagtatcctaaggtggcgttggaggctaagtatcctaatgctcgttctttagctcattttgatgattatgtgagttttttaaagaaaaaagcggcgaatgaaggggtttccgcagaggcgctaaatacggcgttgaatattcaatatgtgcctcgtgccgttgagttagatcagcaacaagctagtcgtcgacgtgatcctaatttacctccgccaccgccaaatccaaatggggtgacgaattatttgaataagaccttaacccaagcaaaagtggacgtggcggcacaacgttggtggcaatatcagcctcaattaaccaaagcaagccagaaatatggggtgcaaaaagagtatttgatggcgttatggggtatggaaagtagcttcgggcgttatcagggcaattttgatgtgttgtctgtgttggcgacactcgcatttgatggtcgccgagagaagttgtttactcaagaatttgtcaatgcaatgaagatgttgcaacagggaaccttagtgcgtgccgagatgaaaggctcgtgggctggggcaatggggcagacgcagtttatgccaacctcttatttgaactatgcggcagatggcgataacgatgggcgtaaggatatttggaaaaatcagtatgatgcctttgcttctattgcgaattatctggcaactgttggctgggataaggacttgccgtggggggtagaggttaagttggctcaacctatcgatctctctttttctgggattgagttgaataaagcaaaaagccttgctgagtggcaggcgtggggtgtttatttagcctatccaacggctcaagaaacaacaaaactgaatgcgttgagttcagagaagttgtggttggttcgtcctgataaagaggtagggcgagcgttcttggtgtcgaataatttccgtacgattttagattggaataagtcgaataattttgcggtgagtatcgggaaatttgcagatcgtattttgcagagcgtagagtagggaagaacgatggcgacctatatcgtgggagatttgcacggctgttttgatgaatttcagttgttgcttgagcaagctaattttgatccgcagtatgatgaactttggctaacgggtgatttggttgctcgtggcgagaactctttggcttgtttgcgttatgtgaaggctttgggggagagggcaactgtggtgttgggtaatcacgatgtgcatttactttcgacactgcagggaattaaagcggtgaagcctaaagataaggttgatgcgatttttgaggcggaagatcgtttggaattgcaaaattggttacgctctcgaccgcttgtggcacaacaccctgttcatcaatttttgttagtccacgcaggagtaagcccagaatgggatttagcgaccactttagcttgtgcaagggaagtggaagcggtgttacaaggtgagcaatttgcagattttcttgctcagatgtatggcaattcaccagaccagtggcgtgcggatttgcaaggcattgagcgttggcgttatgcattaaatgtgtttacgcgtatgcgtttttgttatgcggataagcggttggattttgattgtaaattaccagtcgaagaagccccagagggcttaaaaccttggtttgaactagataatccgttttatcgccagcaaccgattatttttgggcattgggcgagtttaattggttatcaaactccagatacgatttatgcgttggatacaggctgtgtttggggtaatcatttgacgatgttacgttgggaagataaacatatttttacacaaaaacgcttaaatttggattaaaaacaagcggttggtttcctacactattgcgttgttttcgctttttctttagaatacacctcgtttttatgcgactatagctcagttggttagagcaccaccttgacatggtgggggtcactggttcgagtccagctagtcgcaccatatttctaaatcatttcgtatcaatctatatcaaatgatatataaaagccttgtaaaacaaggctttttacatttctgctgtatcaatccatatcaaactatatcatcctatatcacaattttggtattatatctggtattatgttttagtattttttcattatgtaataccaaaattaagaaaaatgacgcatttttcttaataccaaaatgattttggtaataccaaatgagatatatatggcagttacagttaagcctttaagcgttactgaatgtaataatgcaaagcctaaagagaaagaatattcactttctgacggtttaggtttgttcctacttgttagagctacaggggctaaaatttggcgtttccaatattataaaccttttaccaagaaacgaacattaattagtttaggggcttttccgtcagtttcactcaaagaagctcgtgaaattcgtgatctttatcgctctttattggcaaaaaatgtcgatccgttagattatcgcctatagcaagaaaaagcggctttagaaagccaagttctcactctatcctcgatggctactgagtggttggtattgaaaaaaatgaggtagatacgggcaggttaaaggttgtgacctacaacgatattgaaaagcgactaaatcggcatttgttgaaattgcttggtcactatcctattgcggacatctcagcaccaattgcgattgaaaaactaaaaccattagaacgagaaaggaagctagatactttgcatcgtatgatcgggtatttaaaccagattatgatttatgcagtaaatcgaggggctattaaatataacccaacagcagacattggaaaggtttttttgaaacccgtcgtagaaaataatcctactattcgtcctgaattattaggcaaactgtttgaagatttacaaaatagtacgctagaaattgaaactcgttgtgcattagaattgttgatcttaacagcagggagagcaggagctattacacaacttgaatggtctgaagtgaattttgaggaaaagattttggatattccaaaagagaaaatgaaggggcgacaagggaaagttcaggattttgtgcttccgctatctactcaagcgattaaaattttacagcttttacaaaaattaaatcgctatcacagtcgttttgttttccctagtcgtaaaaatccgcaccagccaattagtaaagaaacgcctaataaggcactgcaaagaatgggttatcgcaatgtattgactgctcacggactaagatcggtatttagcacagcaatgaatgaggctgagtttaattccgaaattattgaggtgtgcttggctcattttgaatactccagtgtacgaggtacatacaataaagcaaaatacttaactcaacgagctgaatatatgcaatggtgggggaattttgttgagcaagcagctgaggggaaagggttatgcagttgaggtgcattcactctgaattgtatcaatatagtggtttatttgttcattagaccaaaaatttttacctccgatcagaagtggctttgggaaatgtttgtcatttttcattcttctgttaattgttggtacactgacatcaagcagtgtagcgacagattttttgtcaaataacatttttgttgtattttccatcttttcctccaataaaaaacctagctttcgctaggcttgttcgttgatccataaaataaaaccgcccataaagagcggttggttgtggttaaaagtttgctaatcgttgttgattaatctgtggcaagacttgctcaatgaatgggtcaagccacacgttaaactcgtgtgcgatgtcgtaggcttttcctgcaatatcgtttttaacatagcgagaaatgcccaaatcttcgtacagtttacggtggaatacttccacttcttttgcaaaagctctggctcttactaggtatttggcaatttgttctgctttttcgtgtggaagaacgacatcaggcttaggttcaagcggtgcgatttgttgttcattttccgaaatttcacgatcaagaatatctagcacccatttgcgaaaatctttggcgactttggtgcgggcgaacattgcgataaggtgagctccacgcaaagagaagacgcgaacttgttgttttccgcctgcggtttgcagttcgataagtgcggtcatttctgcagtaaattcgtctgcgttgcggttgtaaaggtttggaatatccgctgatggatttttatagcctaatgcctttccaagatcaaatgatgtaaagaaagttttatttttttggctgatcaccgtcattgcggtgttttgaaatgttaaagttgtcatacgcttattctctaattgaaatttaattcaatcatcacgagcaactgcgattactggtgatgaactaggcaaggttcgcagtactggtgaataagcggttaaacttccagcgggctttcgcccccttacctagtccatcattgacaacttttcaaagggagtgtcaatttggaacacccttttgaagttttaagggtcttgcaatttgcaagtacctttaatctgactagattttggctataaaaaaagtcgcttttggcgactatcattattaccgccacttattctttcaggactgcgatcccgactttctgttgaaagtgggggtatcttaaactgaattgggagcggttgtcaatgcggttttttaacgagaaccgcaaaactcgccttacttgttaccacaacgcataaggattataatttgtacaaccacaacgtataaattaggatttgttatgtctaatcaaaagccatctcaaccaaaaccacaaccaaccccatctaaacctcatcagcctgcttataaaaagcccgaaccagtgtttgtaggtgatagtgtagatattcctaagaagaaataattagggcaaataatgtagtaaacttgaactaatcaccattaataaaatcggcaagctgatagcagtcataatcgctctatcagtatatttccggtatatagcattggtattaagcaaagataaaatagcttggttgatgttatgtaattcatagcgtcttagtatgccaagtttatttttatcttggctgtttttgaatgattcgttataaagattttgtggaatgtttgttcccatttgtcgtattttacttaataaaacgtaatgagttagcataaatgcggatattgtccaacccgccattagtaaaatggcattgacaataataatgggatgtattttatcaatgctgtttattagcagtaatgagatagaaccaatacccaaaagcagataatttaataggcggtaggctttttctcgattgttttcgtttgatttttttacatcgtcataactctgtaaggcttgtttttctaaatattcaagcatttcatcatcaacatctaaaaagtaatcgtcgggtaagttcattataattctccaaatatttagttaaaatagctgaggtgctaaaggataaaaaagattagtcatcttttaattttccatctagataatttagaacccattttacacagtataaggcaataccaatataaacaagtgaatatataaatgttgaaaatgtcattgttgaatccttaataaaaaagcccacgttttgtgggcaaatggatcatcattatgattacgggtgttttaagtgcttaccgtgtacacttttgttcagtcagaactagattttagaaatcgtgctactgtttcattgttggttatttcacttattacttcagcatcactgtatttgttgatcgcagaaatggctttgcaagcctttagttccaaaccgtcataatacggagtaattttgatggaacttagaaccgcttctataatttggtgtttttgcaccaaattaacggttgagcttgttacactttccgcttttgagtagttttctgtgttcattttgtttaacctcatttgtttgttgccattcagaaccgctctcagcaagagtgaaaaattcacattaaaaaagcctcttggttagcctgaaagcggttttgaatggtgcgttgatttgctacgctggctcaacgctaagcctcgatagccatttcgtgggtatgcacgaaatggtcaaatttattacttgcgtttgtgctacctgattcactgccagtgcttaacctttccacaagtaatcacaccgcttgagctatggctttcacatagcttgttgataccatctcacctttggcaagcggtgcgtttttgtctaaattgtgtcgagatgaaataatggaattagccgcctttttggagtaatctacgcattaaccttgctatttttgaaagcgggttttcagggatatatactgaaagatgtatctcgccatcaacggtcgcttgggacattgctttgactttttcttgcgcctcttcaaatgagttggcataaatttctgttgcccacttctttccgccgaagctataagaaacagcatagcatttcattttttcttgcataaggagttacctctatgtattttcaaattttccaaggtgttaatggtcagtggtattggcgattaaaatccgccaatcacgaaaccattgcttctagcgaaggatatacaactaaacaaaactgcttgcactgcataggtttagtgatggataccacgcaaaaaacacctgtttatgaagtttagtgttcaagccctgttggagcagggctttaaatccgtatcaactcccgacaactacgtctgattttctctttggctcgaactgttgttggtttgattttgcctttgttgcaagcgtaatttgcaatatcaatcatttttttgcttggtctttcaaggcaggctatatctactcttgaaagggtgttagcggtctgttttttgcgattttttgcgaacattctcgctagtctgccagctttacccgttgtgcgaacttctgctttttcgcagtatttgttgcttgttgggttacgttcgataatgattttagtcattgccgtgtcctctgtttgttgtcattcatagcgacacttgtctaacatttcctttccgatctcagttcgttgtagataaatccgcattgatgtgagatgttccagttctctgtaaatgtcgctatgaatagcaattcctgtttgcctcagccccactggtacaggcgaccaaccttgtttggtgatgtgggttattcgtgttgttaaagagcattgagccgtagctcgttttgatgggtgtagtttagtaaatattaaacattaagtaaagtgtttatttagtaaaaaataaataaagtttagtatttgtttagtaatttgttgattttaaagggaaataaattttgtaatgtgtgtttgattgattgttttttgagcaatgaaagggttgagatatgagaaagggggaaaaattagtgagaataaaggaatatttcggaaaaatttgacgcaatgaattgttagatttataatttaaacaaatcgaaggcgttggaaatctaagttacccaaggtcgattttattaagtgggggcgttggaaatctaagttacccaagaccacttaatataaaccccgagctgatgagttcggggtttttgtttattggtcatcattgggttttatgctgtcgcctttaggaatgacagaaaacaactcagcacggggtttctttgatgttaactctaaaatagcacgatcattcactaaattaccgtagccatcgtgacgttggtgtgggttttctagggcggtagctcggtttgatggtacaaggcaagaatgaacggataatgcgctttctgcttgctttaccatatcgttaatattgtaaccgtctttgcttcggctttgataatgatggcgaccaatatagacaatttcattacattcaagtggtggcaattctgccttttttctatgttgatttatatcaagaaattgtttatctgtgaatgagcctattacttgtaatttcgctttctttccttggcttatttcggttagattttgtctaataagtgcttttgcattttcgtataatggcatagattgtattttcactaagttatttggaatatattctagcaaagaattaggagtttaatatggtagaactacaagattttgatatggcggaacatttaagaagtgaagaggaaattcagctttacttaaatgaggtgctaaaagaagatgatgtagatttgattttatccgctttaggcgatattgcgaaggctcgtaatatgagtcagatcgcaagagaagctggtgtaagccgtgaggggttatataaggctttttcgggtaaaggtaatccgacattttctacggtgcttaaagtcatgcgtgctttaaatcttacctttgaagtaaaacaagcggttcatacttagataaaagaaaaccgccacggtgggcggtcagttgtggttattaaatttgtcacaaagctttttgagtgatttttcagaggctttttttggtaaattgtttctcacattactgcgtttttgcgctttagcaatgcgatcaccaaaataacgcttgaaaatttcgtagtcaggtttggactctggctctatttcataaaatgaaagtttaccataaatagcgcatagccaatcagcacattgaattgtttgatataacttactgtctacttgtactggtgcttcgattagctgaaatttgctattttgatgcatttcatagattgcattttttacaatacttgcacttgattcactatcatccataaagatcagaaattgatcttcttggtttttaaattcatcatctagtcgtttgataatctcttttaaactagataaataaacccgttgagcatcgtgtttatctacatctttttgcttggcttcaccaacataaaataggaaacctccacgttcggttatttgatttataatgcgattggtagagcgtgtgatgtgaattgtatacctttgtagatttgctacagagtactgcttggatcctttcttttcccacgtcgaaagtttaaatacttgaccttgttctttggcttcttttcttgcttgaggaatatcataattttcaaacaagtattgcttaagattgaaaaagaaagaagagaatggacgaacctcttcaataggcaagacgaacccacccaatccaaaaacagggtgagttttatgtgttgggtgatctacggaaacataaggaccaacgtgaccaaattcatcaagataaacaatataagttcgagagggatgcatatactttccataacttaaatacacggaagcccaatcataaagactgggccccggaatcagcaacaaagaatcttgcaatcctctgcttctgacgactaatataaggctttatttttaaaagtcaagttttactttataacaaattacggtggatccgttacaaataactcctatgctcaactattctctatcttcaatcaacaacggcttatcttttaatggttcaagtgattttgattttaataaggattgcatttgttgaatggccaggcggtttaaaatagtaagtcgctctttttgtgagacaccttgctctatgagtagtgcattttggctttctagagcggctaataccgtaagttgctcaacgctggcataatctcgaatgttgccttttaatgtcggattttgctcacgccattgtttggcggttaaaccgaacatagcttggtttagaatatcggcttccgcagaatacacaaatattggttgtgtgctgttcagtaatctgggaataagatgtgcttgaatagcatcggtatgaatgcggtaattagctttgcttagaatacgtttaacattccattccgttttattttcttgggcttctttttgtttgagacgttggaactctttgatgagatagagtttaaactctgggctgagccaagagccaaattcaagggcaatatccttatgagcataagtaccgctgccataacgccccgttttagcgattaagccgatagcatttgttgctgaccactttttgacagacattacaaagcggtttaagccgatattatttttaatttggtgtaattccaccaaattaaaatttgggttgttaatctcttcccaaacttgcaaaaattcaatggtgtttttgttttgtagccagttttttatcagttgatcaccatcaccaaaggctttgcacatatctgttaggctgatatagtcttcgccatttcgttctgtaacccgaatttctgtctcttgtacgattattacatcattaggaaccataccattctccagttttaattatggcgaactcgcctatttactcaataaaattcaatagttgctacaagtagctcctatgctcaactgccacgccaatagctacaaatctttagggtttattggcaatactcggataaatttcccaaggataattgcagtatctaagatttctctctttatatcaaaaggctcgtaagtcttgttgtctgataaagctctataaacgccccctggaattttttgtagtcttttaatataaacttcatcatcaatggcaaaaatatacacaccttcgttatcgtaataattgattgtggtatcaataaaaacgacatcacctttgtttattgttggagccatgctatcagttggaatagtgatcatctcaatgccattgcttgattttctccctacaatttcaagcaaaccatctaaggagaaatagatagattgaataatttcgggatagttagtattgataaaacctgtttcaccagccttagctttaaagttaattagatgaataggatattgatgagaatgtgtttcttgaatggatattgcagacacaatagcactttctgtttcttcatcatagtctaaataaaagctaggcattccatactcattttctaatcttcttgctgcacgctcaccaaaagatgattttcctgattttaattgtgatatgtagcttttttccttttctggaatatctctcgtactgaaccattctgtaagtttttttctacggatctctggcagagtcatatttttaatcataactaacctcacttttcatttttaaatcattctatttagtatttcctaaataagcaaaaaataaactttacttgactttgtatttagttaaatctaaactaaatctaatttttacttaacaggagtgatgatggacttaactagttatttgtcagatcgtcctcgtggcttcaaagctgattttgcaaaaaagcttggtatttctaaatcttatttacgacaagttgaaacaggatattcgccaatgcctgcttatcttgctaagaaaattgaagaagtcacgaatggcgaagtagccaaatctgagcttcgccctgatctgtgggattaatttaccctatgaggtacgcaatggcacgcaatgaattaagcaagtctgcaatgaagattgcggacttaatcagacagaaagcatcagagacgaaagatgctcaagcggcagaatatgttggtgtagatgcatcaacgatttgtcgttttaaggcagaacatttagacaaattctgtgcttaccttgatttttttagaattggaagtatcagagaaaggtttaaatcgtttgacaaacagtgaactggatgccctcaagctatttgcagagaagggcgttcatgctattggaaaataaaaacccacgctggaacgtgggtatatcaaagggagataatgtttatgaaaacagagttattatctactaatcagagagaaaatgcaaccctaacgatgagtagtcgggagattgcacgaatcacagaaagcagacaccgtgatgtgtgcttatctattagaaacctgatgaataaaggggtaattggggggtatgcggaaagtccgtacacccatgagcaaaatgggcaagtctattacgagtatcatattaataaacgtgatacttatgtgattgtggctcaattctctcctgaatttactgctcgtttagttgatcgttggcaagagttagagcaaaagcaagtgcaacaactccctagctattcagaagcattacgccaactcgccgataaaatcgaagagagtgagcaaaaatcccttcaaattgcctcaatggaaagttatttccgtaatgggatttcaccgtttgagtttgtgaaaggcttgaatggagtgaacgctttgaaaattggggcgtttttagtggataaaaactggctctatcaagatggtaatcataaacgtgtgaagtcgtacgctcgtgatcagtatttgacggaagaaacgacggagatttcgcaacacggaaaagatccgtttgtggcatataaacctgttttactcaagaaaggggcggcaaagctctatgagtggtacacaaagcgagaattaccgatgaaagcaaattggaatggcgtatttactcaagataaggtggtggggttatgagttttagccaaaaattacgccaactgggacagcctattgcgtactatccacaattagcaaaaccgttaggcggtgtgacagcggcaattttatttgggcaattattcttttggctggataagacctcaaacccattaggcgtatataaaacacaagctgagcttgagcaggaaacgggattaagtcgccgtgagcaagaaacagctcgcaaaaaattagttgagctaggcatcttggttgaaactcacaaacgcttagagcaccgcatttatttcaaactggatttagttaaatttgatgcattaatggacgacattcgggaagaagcaaaaccgccattacccaatgtcactaatgaacattccccaatggcggaaagcgacattcgggaagaagcaaaaccgccattcgttaatacagagaatacttcagagaatactaacaataatacttccctgacgggaagtataaacgcgcgcgagaaaaaatccgcagatttgattttgttggaaagttttgggattaccgaacaactggcaaaagatttcatcgttcatcggaaatctttcaaagctccgatcaccgaaactgcgttgaaaggttttcagcgtgaggcggataaagccaaaattcctattcaacaagccattgcaatttcgattgagcgtggttggcgtgggtttaatgccagttgggattggcaaaatgacggagtttctgcaaaaaatccacaaaatccgtccgctcgtaatacttccaagccatttatccctgatgacgaaggcaactgggcggaaggtatgtctatcacgctaaggggaagttaatgcaaaacgtggcatcaatgaacttgaaaagccttgtcgggcaagagccaaattaccaagtgccagcaaagacaacggcaattcctgacggtgcgattagagccgttaatcaattattcattcagcttcgggcgatttttcctgcatggaaaaattcatttcctgatgcagacagttaccgtgaagcaaaacggatttggcttgaaacgttggtgaatgaaaaaattacgacgattgagcaactgcaaaacgggattgagcgagcgaaaaaatctaaaaatccattctggccaagcgtaggcgagtttgtggagtggtgcaaagcggtggactacgaagcgttaggtttgcctgatgaggataaactttacaagcggttacaagcgtttatgaggtttggtatggaagaaatccagaagtttaagtttgtttctacggcggagtattacttgattaccgatttgtatgtgcgttgtcggactggtgaatggagcgataagcaactcaaagatgagattaaaaaatctctcgtcaagatgagcaagcggttaaaaacaggggaggttttaccagaacccaaactggcattacctcaagaagtgaaagcagtcgatcgtgaaaaggtgagggctttctggggtggtttgttgaaacaggttagagggagaagatgagtttggattttattaagaaggtaggtgggtattttagaaaagagcaggttggtaggtatggagcataagcgaaaatactttttacgcactgagaaaattaaaaacaatgcccttgaatttgtgaaagcgttgccgatagatgagaaaaaaccgttagtggttgaagtgaagcctattactcgcaaccttgagcaaaatgccaagtttcatgcaatgtgcggcgatattgctaaacaggtgcaatttaacggcgaatggctaccgcttgaaacgtggaaggttcttttaatttctgctcacgcagaagcaacgaaagaaggctctcgtttggtaacaggattggaaggcgaattagtgaatattcgtgagagtacggctcaaatgagcgtaaaacgaatggcaagtttaatcgagtatgcaacttcgtggggtgtttctaatggggtgcattttaatgacagatggaatttttggggggtgaaataacctacgcttagtggttaagcgtaggtgtaagcgttaagcggttaagattttatccgctgcgattttagctaagaagttgctacggtttttatactctttgtgaacggcaacaaaatcatcaatgcgtttgatgagatagctagggagggtgatgttgatgcgttcggctttgccgagtaaatggctaatatcaacatcaacaaagccgaaaaagaagtcatattctgcaaaatcagggtttttgcggtggttatcaatggaggttggcatcggaatttcttctccatcttcaactaagccttcaaggtggaacacgatggcttctttgacattttgatatgcttcttcgagggtatcgccagcagagaagcaccctggaatatcaggcacgataacgccgtaagcgtgagtttcgtcacctggttcaattgcaattgggtataacatattttgtccttgtggttatagcagggctattttagccccgcttgtttaagtattgagagttcagttcctttttttaaatcctttttcggatgaggcactgttactcgcccttgtttagttggatgtttgaattgatggtggcttccacttgttgcaactaagtaccaaccgtccgcttcaatcattttaattatggttttgctatccacattattgtgctcctttgttgtttttcatgtgtgtattatacttatttttatgtttttatcaactgtttatatgtaagatgtgtattttaggtgaataaatgaaattttactgcccaaactgccaatcaattcttaaagactggcgtaggttttctgaaaaagtcagagattaataaggagaagccgtttgcctgtactggcttgaagtgcactaagcggtggagtgagaaagaattggaggcatttaatgataaagccgaaagtgaaaaagcgtaaatgcaaatgctgtggtggtgagtttaagtctgcggatagctttagaaaatggtgtagtgctgaatgtggtgtgaaacttgccaaaatagcccaagagaaagcacgtcagaaagccatagaaaagcgaaatcgagaagaaagggcaaagattaaagcaacgagagaacgtttaaaatctcgttctgaatggcttaaagacgctcaggctgtttttaatgaatacattcgtttacgagataaagatgagccttgtatttcgtgccggcgttttcatcaagggcagtatcacgcagggcattatcgcacggtaaaagcgatgccagagctgagatttaatgaggacaatgttcataaacaatgtagtgcttgtaacaatcatttgagcggaaatatcacagaataccgtatcaaccttgtacgtaaaatcggggcagagcgagtagaagcattggaaagctatcaccctcctgtgaagtggtcggctgaggattgtaaggaaattattaaaacgtatagggcgaagattaaggagttgaaatgattagattgcatatcagcattgacgatattttgaatgtttgggttcgtcgctgggcttctcatcgtgggtgccgtggttatccatcattacaatcctttatgcctgaggcaactgctcaaattacaaagtatagtattgatgaactgtcagaggaacagtatcttaagctagatgaagctgtgatgacattacacgatttgaatttggaagcctatcaggtgctaatggcggtgtttttacaagggcaggataagaagaatatttgtcttgaaatgcagatttcaccgagaacctatgacaaccgtttacgcaccgcacgagattttatggaaggggcggtatttggttcagggttgattagactgaagttttaggcgtattgctacgcctgatttaccctttactgttgttcaattggttgattttgtagttgttcaactgctaatttaatcagttgattttgtggaatgtttcgttcacgggcaagttgttcaattagagcgatggtttccacactgagtttatatgactttgcttttacaccacgcttttcatctgagcgagcttttatttcattgattgacaatttcattatttttccccataatttgaagaactagggagcggtaactccctagtaagttatcggattagtaaactggcaaagaccagagtaacaaaatgataactaggataatgtatttaaacatttgattatcctcttcaagcgtgaggattaagcctcacactcgctttcagtccgtgttaaatttcctaggtctaactactgaaagcgatgttattataattcggtgcaccgaataaaacaagtattattttagaaaagcctacatttttcggaatgtgggctttttatttgacaaataaaaaactgagtagtagtattcgttacataggtgtcgaaacctacacggcggttagtccgcaaaacctaaaatcctttgcggtttttttatatctaaaatttgtactcttttgtttgttgccagcaaatcataagagatttagatgttgaaaaggtaaaatttatttcaatgatcgagtgggcgactaatacaataccgaaagggaatacgtccagcctgccgtaggctttcgaaccactcgatcaccctattcactagggtaaatcttaatttcgaaaattaacggagtgacttatgtcaaatcaaatctctactcaaacaatctctttcaacaaccaagccttaattacattcgagcaaaacggtacacgttacactgctatgaagccaatctgtgaaaatattggtttagcgtgggagcctcaattactcagaattaagcgtgatgatattttaagttcaactatgatcatcacgatcatagttgcagaagatggcaaaaatcgtgaaatggtttgcttgccaatcgaatatctcaacggctggttgtttggcattgatgtaaaacgttgcaaacctgaaattcgtgaaaccttaatcaagtataaaaaagagtgctaccaagccttacacgattactggttcaatggcaaagccgaacgcaaaacaaccacagacgaacgaacaggcttacgacaagcagtcagtgctttagtcagtaaaaaaggtttaatctattccgatgcctactcacttattcatcagcgttttaatgttgagcatattgacgagctaacccctgaacaagtgggaatggctgtggagtatgttcacaaaatttatcttgaaggggagttgattattgatgagcctaagaaagaagatgaacaattattaagattacttgtttcagcataccatttttgctacgaagcccacgagttacgagaaaagattgttaaaacatatataggctgggatatagatagacactttagcccacattatcttcataacttaggcattccacttgaacaatttttagaaaagacaagagatttcattcactctaatagcgaacgcattatgtttgttaaaggaatgaaccatttgctagaagaaccgaagcaaacagcaagattttaagcaaaaatttaaacaaaaccgaccgcttgcgacctagcgttgcaagtggtttttgtgtttcaaaaaaataatgcgtttaatcgctcaaaaagtgattgacatcgcgcgagaaaagtagtacatttcagctatgcttgcaactcgtacaagcgagagaaagcgaaatgattttgtagccctgatcggaaacggtcggggctttttgtttgggggttaggatggaacaacgagatattctgttaaaaaacggtgaagtagttcaagaaaaatctcaatgtcactatgccgctggctggccatctcgacgtatatcagactgcgttcctcacttccaaaataggaaaatttatccatttgccggcaataatgacgtaccacaagattaaacatatctagtggtgctgagtaaatttgataaaggttatcacaatggtagaactaaatattgcgttaaaaaatgccgcagagctttatggtgaaaatcgaccatttgtcgatcctgaaagtggaactctaaccctagcaggttgcgaagctctaagtcgtcttggtattggattttccgaaagtagacttgaacctgatcttttagataagttgcgtaagaatctcgctgctctttagtaaaacctgttgtgagtttttctatgaaaaaaaggtgaagatccttttcgagttgaactaagaagttaaagttatttgcaattttggcatctttaaatgtgaattcaatataagagaaatggctattatcatattttcctatccagtgagaacaacctagtgtgataaaggggctatcaggcttgttaagttcaataagtgtggttttaagttctggtagttgagcaatttctaggatttcatctattttttcaggatgattaactaaatcaattccacctgcatttggtgttggattttggcaatcttcagatccatttgatggtcgatatggaaatttggtataaccttcacgaaagtacataatttaatcctctgctagtttatttgttggggaacaatattctagcagtttttttaaccaagctcagtctttacggactgggcttttttattgcctgatatgagggctaaggtatgaaaaatgttatgagagatatgggaacacagacgtatatttggtctggatttagtgggattattgcgtggttgagtgagcaacagaatttaatgattttaagtcttgcgattggtattgtgacggcgtgtgcgaacttgtatcaacgctgtgacgaaggtaaggcgaagcgtcgtgaacgtgagcgagccgaagaagctcatcaaatcagaatgcagatttatcgggtaagggcagagaggttaagtaatgagcaagctaaaaacactaggtaaagttggcggtggggtttgttttgtcagtgccattattgcggtgttgaatacagattttcacggtcaatttcgtacaagtcagcaagggcttgaaattatcggtgatgcggaaggttgtaagcgtgagccttatttgtgtcctgcaaatgtgcttaccgttggcattggttcaacggaagcgtcaagcggtaagattgaaagaaaagtttacacggacaaagagattgcagagcgttggttggttgatattcagcacgcagaaaaatgcgtgaaccgttacgcaaatggtggtgatattccgcaatcggtgtttgatgttgctacttcgctgacgtttaatgctgggtgtggcacggtgagtaaatcgacgttctttcgtaaaatcaaatcaggcgattatgttggtgcctgtaatgagttgcctaaatgggtttattcaggtggcaagaagttacgagggttagaaatccgtcgtgagaaagagaaggcgttatgtttagctgggttaataaaatcttaatggcactgattttgggcttgtgtgtgtggctatggggtcagtcacagaggatagatagcttgaaagccgagaaccaaacacaagcccaaactattgagcaacagcaaaaagcaaacaataagctgacaatgcaactgcaacaagagcgacaagcggtggaatatcagcaaagtattgcaaataaactacgaaagcaggtggagcagagtaatgaacagattaaagctattttacagaaagagccgtgcggcgttactgctttgcctcgtcctgttgtcgatgagcttaagcggttgcacagcaaagacaaagattgagtatttatatcctccgcaagcctttttggtgccgtgtgagcggtcagagtttggtggcacaacctatggtgatgctatcgagtatctcgttaaggtgatgggagagcgtgacttgtgtgcgggtcagattgatagcattagagagtggcaagcacgaactaagcaagggtttaaatagctgattaacgtttgtgtcacggtagagagcggtcagatgatcgctcttttattttatgtaaatcaaatgctacataatttgcgtatgggttttgggattgttggataaatccccgagaaaatacgcaagtgatgtaatttatatataacaaaaccccgatcactgcaaatgatcggggtttttcattacccattaaagccgaatgagtaacgatttatggagattatgacagttttaaccgtaaccatcaaggagatacttatggaatatggtttatggcaaataagccttgcagtaacactacctattttagcgtttgtttcaccaaagctaattaatgccattgctaatttattgaatgttttgaaataaaaaggattaaccacgatgacgaagaaagacgaggttaaatccacgtctaaaggtcgtgggttaacacctaagcaagaaaaattctgccagctttatattgagcttggcaatgcgagtgaggcttatcggcaggcttacgattgttcaaaaatgagtaatgaaacaatcaatacgaaagctaaagaactactgaagaacggtccgattacggtccgattggatgagttaagaagttctcatcaacaacgtcataacattaccgttgataacttgttaggcaagctagagcgtatctataacgaggcgatggagcgtgatacccctcaattctcatctgcggtaaatgcagtaatgggacaagctaaacttttaggctttgacaaacaggttatcgatcatacaagctctgacggctcacttcgccctacggttattgagttggtagcaccaaatgaaaatacagcttaatcttcctcctaaactgataccggtgtttacacagcagaatgtgcgttatcgtggtgcttatggtggtcgtggttcggcaaaaacacgcacttttgccaagatgactgcggttgttgcatatcaacgggcaatgcaaggcgaaagcggtgtgattttgtgtggtcgtgagtttatgaactcgttggaagattcatcattagaagagattaagcaagccattcaaagtgaaccgtggttagcaaatttttttgatgttggtgagaaatatgtacgtacaaagtgcggtcgagtttcgtacatttttgcaggattgcgccataatcttgacagtattaaatcaaaagcacggattttacttgcgtggattgatgaagcagaaagcgtgagcgaaatggcgtggcggaaacttctgcctacggtgcgtgaaagcggttcggaaatttggctcacttggaaccctgaaaagaaaggttcggcaacggatttacgctttagacagtatcaagatgaaagcatggcgattgttgagatgaattatagcgataatccgtggtttcctgatgtattggagcaagaacgtttaagagataaagcccgtttagatgatgcgacttatcgttggatttgggagggggattatcttgaagaaagcgaggctcaagtctttagaggaaaataccaagagcttgagtttaagcctttacctgattttgaaggtccttatcacgggttggatttcggttttgctcaagacccaactgccgcagttaaatgctgggtgtttaaggatgaattgtatattgaatatgaggctggcaaagtcgggttagagcttgatgatacagcgacatttttgcagaaaggtattacgggcattgagcagtatgtaatacgcgcggattcagcaagacctgagtctattagctatttaaagcgacacggcttgcctcgtattgatggcgtttcaaaatggaaagggagtgttgaagatgggattgctcatattaaatcctataagaaaatctacattcacccacgctgtcagcaaaccttgaatgaatttcgtttgtatagctataaaacagataggctaagtggtgatattttgcctgtggttttagatgaaaataatcattatatagatgctctgcgatacgctttagagcctttaatgaaaggtcgacaatcttggtttgggtgagtgatatgtttggattttttacaaaaaaaacggaagaaccttttgaaataaaagaagcagaagacagctacccaaatttcccaaaagacaaaaagggtagtgaatatcaacgacaactacaaaaaattgagcaagccaacaataacattttagctggtggtgatgctcaagatggcgatgaagaatctcggctaaaaatggcgttaagagcttctgaagttgtgagtagctctgttgttgattggtttgctagtcaatcctttatcggttttccattgtgtgcggtattaagtcagcaatggttaataaataaagcgtgttttgtaccagcaagagacgctaccagaaacggttacgatattgtttcgatgaacggggacgatattcctgacgaaacagtcaagatcttgcaaagatatgacaaaaaattccaaattaagaaaaattgtgaggaatttgtagggcttgggcgtgtttttggtgtgaggattgcactttttgaaattgatagtgacgatcctgagttttatgaaaagccgtttaatttagatggtgtgactaaaggtagctataaagggatttcacaaatcgatcctaactggtgtatgccttactttgtgagtggcgagttaaataatcctgctgcacggaatttctatgaaccgacttattgggttattaacggcaagaagtatcaccgctcgcatttgcatattttccgaaatggaaaacttcccgatttgctcaagcctgtttatatgtatggtggctatcccgttccacagcttattatgagccgtgtgtatagtgcagaacgcactacggacgaatcattaaacttggttacttcaaaacgtacatctgtttggcttacgaatcttgctcggtttatggcaaatgaaacggaagcgacagaacgcctaatggcttggattaaatatcgggataataacggtattaagctgggtgataaagaaggcgatcagtttcaacaatttgatacaacgctatcagggcttgatgatgttattatgactaactatcaggcggtttcaggtgcttctaatgtgccagttacaaaactcttaggaacagcgccgaaagggtttagtacaggcgaaaacgaggataagaactacaatcaagagcttgagtcaattcaagaacacgatttaacggaatttgtcgagcgacaccatcaattagtgatgaaatccagtgggcttgaagtgcttgatttgacagtgaactggcgaccaacagacagtccaacggctaaggaattggcggaaattaacaaaactaaggcagatacgtatagtgctttagtgatgtctggtgttgttgatggctcagaagtgagaacggtgttagttaaaaaccctgattctggttttcacgatattggtaatgttgattctgaaaacaatcctttggggctttctgatgatgaaatgcaagcattaaaagagttaggggtagatttcaatgaaagcaaagacagcgaaagcaaagaagctaattgaaggtaagccccttattgtaagtgcaggtatttcagagaagtatgctcaaagtgtcgtaaaagctcttgctgtaatgcacaaagaagcattaaaaggggttgaagaaatctacgaaaaatacggacacgcctatgcaagtgattccgctggacaagatgggctaccgaaaggtggctctttaatttctcagctcagaatcttttttaatgcgttacttaataagtacaacccaatattcaatttgattgcgaagaaatcaacggaaaagatggttgagcaaaccttaaagaatacgaaaagcaccttaaatctcagtttgagagaattagggcaagggttggcgattaaaaaagattatacgagtgagcgagtgaaagatattgcacaagcagccacaatggaagcggtaagtttaattaaaacgattccgcaaaaacatttaggcgatgtgcaaaaagtcttaatgcactctatttcaagtgatgggaaaggttatgccgagttaaagccttttttgcaaaaattgtataaaggtaatgcaagaaaagctcacttggtggcaatcgatcagactcgtaaaacttacttaaatattcaagctgagaatatgaaaagtcttggcatcaagaaatttaaatgggttcattctggtggtggtcgagagccgagaaagctacatcaagagctaaatgggaaagtattctcgtttgacgatccaccatacattggcgatatgtacggtcagaaggtatatgggcttccagggcatttaccgaattgtggttgctctatgtccgcagttttcgatttcgaggtagaagatgattaaagttactaaatcacaagctcaaaggattgacaggctttgtgcaaatgttttcgtcatggatgataaatggattgatgctttatatcaaagggtgtgtaaatggcaatagcacaagataaaaaagaagttgatacaaatggttggttcgaagtgaaagacaaccccctcagcaaagagggggtttttctttatcggggcaatcaaattattttgcctgatggctcaagagcctcaaatacagatgatttgattcccgtatatcgtccagccgatgaacttagtaaccctgaagcaatagacagttttaagctcgttccttgggtggatgaacatactatgcttgggagtgaagagttggggcttacgccagcagaacgcaaaggggtaagtggagtggttggagaggatgtttattttaaagatggtgttctctacggaaacattaaggcgttttcagaaaatctcgctcgtaagatcgaaagcggcaaaaaagagttatcgcttggctatcgttgtagctatgagcgaagttctggggaatggaatgggcagaagtacgattacattcaacggaatttacgaggcaatcatttagcccttgtagataaagggcgaatgggggcagaagtgcgagttatggacagtcaagagactggcattagctatggcaattttatttttacttgtgattcattgatggagaaaaacgaaatgaatttagaagaacttttaaagcaagcggttgaaaagtttggtgattctgcaaccgcattggcagaaattaaaaaattactggatgagcaagggcaagataatgagggaaatcaagagcctccaacgcctcctgcgactgatgatgacgaaatgggcggtaatccagatgatgaaccaccagcacaagacgatgatgaggataaattagacaagctcttatccttagttgaaagtcttgtttctcgtgtggaagcgttagagggtaattcgaaatcagaagatgaagatgataaccaagaagagccacaagagaagcctaaagttggtgatgaagaagagaaaggtgctcaggcaatggatatggcggaagtgacacgacaagttacaaaacgcttaaacgagcgtgattcgatgtacaaaaaagtttctctacatacaggagcttttgatgtatctgcaatggattctgctgaggcagttgcagcgtatgcgtgtaagaagttaaaccttaaaacagcaaaaggtttagaggttgcaacaattacaggttatatggcaaatcgtgagcctgcaaacaaacagcgtattgtttcaggtctggataaatcagatgtagttaagggtaaaaacttcttaactggtcaaatcaataaataaggtggtaattaatggcttttcaacaaaacgtaaacattgaaatgggttttggtgtacctggcgacattcacacagacggcccaacacgaacagaatccttggtggttaattctgaaggtgctcaattaaatcttgtgggtagagcgttcacaaaagatgctagcaaaaatgtagctaaagttggtggtgcgattgaaagtggtcgagtttttgcaggtatcttagtgaactcaaaggcttatgctttaacaggattatctggcaatccattagcaccaacgctagcggtggcagataacactcaagccgatttcttaacgatgggcgatgtcgttgttcaggtttctacgccttgcaaaattggtgatttagttgcttacgataccactacaggcgaattatcaacagttgctgttggtggttctgcttctggtggtaaagcattaattcctaatgcgacggtttatcgcttccctgtaacctctggaagtggcggtttaaccgttattcgtcttacaaactaacaaataaaaggacagaataaatgacaaaaaaatcaactcaacacggttttatttctggccgtgcgaccctatcccaaattctgtgtaaacacccatttcaacttaatggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaatcttcgttttaggatagactgcattgatggcttccaggaagccttttaaaccgtctacacaggcaataaaaatgtcttttaagcctcgattttgaagctctgtcagcacatttgcccagaacttcgcaccttcattttcagcaatccaatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttccggtgtttttagatttttggcaaattccgctgccaaggcgtgaagttgttttcgttcataataaaatacctgtgtctgaatgtattatctcagaaacaggtatttacacaaattgtgggagaggctcggccgtgcttatgctaaagcattacaagagcaacgttctgcaatcactatggatgcggcagatgttgcacaatatgcagcattaaaaaacattggtattggcttttctgatgcatttttaagccaagcaaatgttgcttatggtatggacgatgttcagggtggggtaactgctggctcgacaggctctcctatccagttcttgcaagcatggttaccaagttttgtgcatgtagcaaccgcacctcgtcagatcgatatcttgactggtatttctacagtaggcgaatggcacgatgaagaagtggtgcaaccgattttagaaatgaccggtaaggcagttccttatggtgatacaacaccagtgccattagtagggtacaaccttaactatgaacgccgtacaattcaacgttttgaggcaggttttgcagtaggttctttagaatctgctcgtggtgctgctgctcgtttagatgcggcaaataccaaacgtgcttctgcaatgttggcgttaaatatcattcgtaatgatgtcggtttctatggttacaatgatggcaactctcgtacttatggtttcttaaacgatccgtctttaccagcatacaaaacagtagctcaaggtaaatcaggttctacgaaatggaatcagaagacctttgaagaaatcacaggcgatcttacaaccgcatttactcaattagttgcccaatcaaaaggattaattgatgcaatcaacacgccaacaacattggctcttcctgcgggtcatgaagtcattttaaataccgtcaatgcgttcggtatgagcgtgaaaaaatggctcaaggataattaccctaactgccgaactgaaaccgcacctcaattaactggtgcaaatggcggcgtagattcattctacttatacgctgaagaaatcgtaggtgatacatcagatgatgatcgtcgtgtttggattcaagctgttccagctcaatttatggcattaggtgtcgatccgcaagggaagcgtaccgtagaggacaacacaaatgcaacagctggcgtaatgtgtaaacgtccttacgcagtatatcgtgcatcaggtatttaaccttaaccactcaagcccagttaattctgggctttaatttttaaaaacgagaggaaacaacaaatgaattacgtttacagcactttgacttgtgataacgcatatacggtctatgaaaaaacaacagggggcttaactatccctaaaaccgaagtgattattcacggcggaacaggattggcaaataaacatctgattacaccgcttggtacggttacaaaagtaagtgatgatgaacttgcgatgttaaaaacaaacccagtatttattgaacacgttaaaaatggctttctaatcgtccaagaaggcggtaaagctgacgatgcggaaaaagtagcaagtgatatggcggtagatactggtagcgcaccactaacagagcaagatgccgaaaatacgggtgtaaaaaaagcgaaaaaaggtaaataaagatggatattgctacgttcagaaaaatgtttcctgcttattctgatagtcaaacttttagcaatgagatgatcgaaatgtggctggacgtagcaaatgttcatctcaaaaaaggctggtcgttaagtggtaaaacctacgaacatgccattatgttgatgttggctcatcttcttcatagtgttgcgaaaacttcaagcggtaatgctgaatcaggacctgctggaattgtgacatctgcgacagaggggagtgttagtgtttcttttgcaacacctacgacaaaagatgcgtgggaattctggcttgcatcatcgccttatggattgcaactttgggcattattgcaacagttaggaactggcggtttgtttattggtggtttaccagagcgaagtgcagttcgtaaggttggcggggtgttcttatgagtcgggcggataagtttagaaaggctttgcaagataagatcgacaaattgagtgcagccaacaacaaagtcgcaaaagtcggtattgttgaacatcaacattatgatgataacacgccagtagcttatattgcttcaattcatgaatatggttctcctagcaataacatcccgccacgtccttttatgcgcccaacagtatcagagaaaaaaggtgagtgggcgaagataggtaagcaaattctgcaaaatggcggtgatgtcgatagtatgcttgaaatggttggtttaagggcttcggctgatattgttgaaaaaataagtaatattgatgttcctccactggcaatttctaccaaaaaagcccgtaatcgtaaggctcaccaacaaactgccaaatataacaaaaagccgaaagcggtgtctatcaaacctcttgtagatactaaagtattaatcagctcaatctcccatatcgtgacagataagggggattaaatgcattttagtcaaactaatatcaaacggattgaaaggctattgcttttatgtgcttgtgataaagattgggatgaaagcaaacatcctagagctgaaaatggtcagtttgggaaaggggctggttcagctaagaaaaacttggataaagaggcaacaaaaatacctagcgtgacgggtaaagagttaggtaacgcaaaagacattaaagatctgagaacacgagcaaggctttatgcaatagaacatttctccggaaagaagtttgttaatttaagtacaggtaatgaaattcaggtcggtgctagtggtataaaacatactatatcgggtgcagcagaggatttgattaaaacgatccctgccatacctgaactaattgaaacagcgactttaatgcataaaaagcaagataaaagaggcgatcctaatgttttatcggttgagatttataaagctgaaatgaatgttatgggtaaaaatgccaaaatgatattaacaatcaagcattataaagatggacgtaggtattatgatcatggttatatgcgagaatagaagcaacgtaataatccagcaccttaccgcgttcaagtgcggtacctcttaaattatcacgctgcttcattggttaaaattatagctctaatgattatttaatcaaggattttatatgaacctaagatctattgccaaccaacatatcaccacggtaaaccccaatattcaggcaacactaaaactaaacacaggatatgaaacaagcgacacaggaaagcgagtatcaaagtttgaagaatttcaggtcagcattcaggctcaaagtctgagtacgcaagatttatctttgtttgatacgttggcacaacaagggcaaatgctgaatgtgtatgtttcagggcaaatccacgcgctaagacgcatttcaaatcaaggtgcggataagcttgtttttaaagcatttggcgaagagagcgaatctgaatggctaattaaatccgtttctgagagctttcctaactggtgtaaggtggtggtatggcggcagacataacaacaacccacgatgatatttatagagaagtccgagcttatttgcttgggcttttttctttagaaggcgagagggtgataagagattatagcaataatgtgcctctgccgcactcgccttttattttgatgaacatcatttacgagcaatcgttatctaccaatgttcactcctatgatgttgaaaacgcattagcttctgttatgcaaagtgtagaagtgcaaatgcaaatagatttctatggggaaacaagcggtcaaatggcgaggattttttgcaatttatggcgagattatcacgcttgcgacaggttggaaaaatgccagcctctttattgcgatgaaccacgctatttaccttttactaacgaggcgagcgagtatgaagaaagatatacagtaaccgcaaggcttgcttataaccctgttgttgtacacgctcaagattttattactaaaccaaacccaagcattgagcttggaaaactataaggaaaaactatgtttcaatcgattccagcaagtcagattgtgaatgtgaatccgtccgtattgagttctggcggctccccactttcgatgaatgccgttttcttaagtgaaaatgcgaatttaccgacaggtcgagcggtttcatttgcaacggcggattctgtaggtgaatatttcgggtttacttctgcggaatatcaagcggcggcagtttattttaaagggtttgatggttcaaccattaaacctggtacgttaattttctttgcttacaataaagcaatagaaggtgcattcttattaggtgcttctgttaaatcattatcgttaaatgaactcaagaaaattaacggaacactcagtgtaattattgacggcagtgagaaaaaagcagattcattgaatttaagtggtgcaaaaagtttctctaatgcagctgagttaattggtacggcgttaggctctgtaacagtgacttttgatagtcaattacaagcattcaaggttgcttcttcaacgactggcacaacatcaacgattgcgtttgcaacaggtgcaactgcagatgctttagggttaagtgaaaatgcaggtgctacgctttcacaaggctcaaatacaactactccgacagaaaccatgcaagccgtgattggttcaacgcttaactgggcaacatttaccacaatcacagagccgacattagaggaaaaattagagtttgcaaaatggtctaacaatcagaatcaacgcttcttgtatgttggttggggtaaagaggctactgcaacacaaacaggcaatacaacaagttttggcgcgaaattaaaagagtctgaatatagcggtgcaacggctgtatatggtggtttagataaagcggcattcttgtgtggtactgtggcttcaattgattttaccgagaaacaagggcgtattacgcttaagtttaaaggtcaatcaggattaaccgctgatgttaccgatgccacaattgctaagaatttagaagataatggctataactattacggtgcttgggcaacggctaatgaccgcttcttgttcctatctccaggtcagatttctggggaatggaaatggatcgacgcttacattaaccaaatccgcttaaatagccagctccagttagcgattattacattgctaaccagtgcaaaatcagtcccttacaatgatattggtattgcgttgcaacgtgcagcgtgtaatgacccaattaatgaggcattgaactttggttctattcaagtgggtgtttcgttgagcgaacaacaaaaagcaatcatcaataactacacgggtgttgatgctgcttcacaagtagaggcccaaggctattatctttacattggtaaagcgacagcacaaacacgaggaaaccgtgaatcattcccgatgaagctattctatacggatggcggtagtttacattccgtaaatcttgcttctatcaacgttcaataatgtaatttaatccataaggcgacttatatttcaagcaaatcgcctttttctttttggagaaaaaataatgcaaacaaatacctcaagaacaattacctcggcaaatgcggtgcttttagcaaaagccgttggatatagccgtggtttcgttcagattgaacagtatgcggcagataacgcatttacgtttaaccaaacggcggtaacagaaaccacaatgggcgtagatggctatcagtctggtggttgggttcctagcgaaaccgatttcaatattgcacttgcggcaaatagtccgagccgttcatttttcgatggcgtaaaagtacatatgcaaaaccaacaggagaccgtgccttttgagtttgatgttacgattccgtcaattggcaaacgatacactgctacaggttttatgactcaagcccaaagcggtaccagcgctaaaaaagtcttagattctgcaacgtacaatttcaagattgtggtgaaaacagaagaagatatttaaccgactgactaaagtcggttttttattgcttacaagatagaaaagtacattcgaaagcggtgtttactctctcgctcaccgtttcttgtaagcatcttaaaagcgagatttagaaccaatatggagagagaaaatggcgttaaaaacaaaaaaatcacaattgaaaaagggcgtgatgcaggtattacattcaaaattaccgaaatgcctattgcgaaagcggacaaatgggcgacaaaagccttactcgctttaatgagtggaggctttcaagtgccaaatgcaaaagagggtatgcttggtattgctagagtggctttatcggcattaagagaaatcccagaagaaaaggcgttgccgttacttgatgagctaatggactgtgtggaaatcgtcaccgaaagcggtgcgactcgtgcactcgatttgtcgcttggcgatgtacaagacattacgactttatggctattacgcaaagaggcgttatctctccatattgattttttggagcaagagcctaccccgatctcggagtaggcaaaggtggtgatgcagtcgaatatgtgaatctaagtcaagttgtgggtgcggtggtgagtagcaaattagccacttaccacgaattacaaaccgtttacggcttagaggatgctttagatctgctcgaagtatttaccgtagattcatacaacaacaggaaggcaaataatggctgatgtaattgatacgcttgcgatagatattgttgctaatgatagctttactgcggtagcaaaaccatttctcgctttgttagagcggatggagcaggaacttgatagcaatgcaaaagctctggatgaagcaaataaaagcgtagaagggctatctacaaccgttgctgaattaaacgatgccacaagcgaagtctcaaaatctcaggataagcatacaaaagcgctagagaaaaacgaaaaacaatccaagaaaaacgagaaagccgctaagaatcttcttgatggtgttcttgggtttggcaaggctcttggcgctatcagcacaatgattatggctgggattgggcttgatcgtttagttaagcaaacttctcaagctaatcaagaactcgattcaatggcaaaaaacattggaatgagtagccgttctctcgcctcttggcaaggtgctgcggaagcaatgggcggaagtgctagcggtatggctaacacgttgatggggctatctggtgctttaactcgctttcaggtaatgggcgatgcttctgttattccattttttaatgcgttaggagtcgcgcctttagatgctatgggcaatatccgaaaacttgaagagattatgctagagttggcggataagttcagcaaaatggatcgtggcacagcgcttgttatggcgcaagggttaggcattgatgaagaaacgtttaacacgcttgcacaaggcaaagaagcctatcaagagatgcttgcttatcagagtaaaatctacaaatccaaccaagacgatattgaaacctctaagaagctgaataaatccgtctcaatgctaaatcagcaatttgacggactaaaactgatgattgcaaatgcggcggctccagccttattaaccattagcgaattaaccacaaaattctttgagtttttaagccgaaatgaaaaccttgtgaaaggcgtatttatgggaatagctggtgcaatgacagcagttctcattcctacattgctttcaggtgcaaaagccgctttagcgtttatggctccgtttttacctgcaattctacttgtagctgctttggctggtgttttcggattgctctatgatgactataaaaaatgggcagagggtggtaattccctgtttaactggggggcttttattaagtggtttgataaagctaatttttccgttcgcagtttagtagatggtttcacttatttattaacagaatatgaagattggaatgctttagctgaagatggtaagtcttggttaaaacttaaaggttttattgatgaaaacggtttatccgttggctcgttagcaacaggatttaaaaacctagggaaagacattgttgagtatctaatgcctgtatttgatcgccttttagggattttgtacaaaatcattacgcttgacttagaaggtgcttgggaggaagtaaagagcctaggtagtgatagcgtagattgggtaactcaaaaaacgaaagatgcttggggaagtattcaaaactggtggaatggcgtggaagagcgagctccagaagcttttgataaagccgctcaaattcaatctagtgatgaagcctcattaactcaacaaagtaaaaatgctgggtttgttgatactaagaaaggatttagcaaaggaaactttgtctttgaagggcagaaatcagctaaggggctaacacaagaagaaacaggagcgttagctgctcaaatggtcaagcgtgaaagcggtggaaaccttagagcagaaaatcaatatggatatttgggattatatcagttcggtgcggcagcattagttgatgcggggttaatcgatgatgctaaatatagagcagcagtaagaaaatatggtaaagggttatcgaatggctctgatgctgatgttcacaaggcatttttagcggattcaagtaactggaccatcaaaggtggtcgagaggcatttttgagtagtaaagccattcaagataatgcaatcgtagctcttatgaataagaatgtggggtatttaggctctacttatcaaggttcagcagaacataaagttggcttattgatggcagctcacttaaaaggagcaggcggagcgaaagccttcgcaaactctggtatagatagtacagatggtaatggaacaaaaatatctgattactataatacaggtcaaaaggcgattcagttagccaaacaacaaggaaaatcaaaccaaagcaaacctatagattggaatacgcctgttggcggatatatggtagcaacagccttaaatgcaacacaacaagcaagacagactatgcaaaatcttgctcaacctcaaaacatcaacagtaatcaacgtacagaagttgtaatcaacggtggagttaatgtacactctagtgcatcaacgataacagggactactcaagatgccgttaatggtcttaaaacgagtatgtcgggattacaattcaatacgggattagtgtgatgaaaaaattttgtttaccatttatcttgatgtcggctcctatgctatctgtagctaatgagtcattgctattttcttgtgaatcggataagaataataatgaatttaggctaatagagcatacagacaagctagaagccgaatatcaagttgttaataagaaaaagtgtttcggttttgattaatgataaatctctctccgatgcccgatttctaaggcggttatcaacaattcgccattatcaatatggcaaataatgcggtaatcgcctacacgataacgccacattccagataaatcgccaactaaacctttgccccgatctcgtggattttctagcgtagctaaggttttaagatagcggataatttgttgagcctgttgaggatttttcttagcgagtttggctaattgctttttagcggtttccgctaagatgatgttccaagttaagctcattctcgacttcctctaatgaataggttttttctttacctgaacggacacgctcaagaaccgcattagctaagagtaaatcttctaaatcttccaaataggcttctaatgcctctttgacataaaaagattttgctcgcccagtttggacggagagatgatctaagcgttgttgtaattcgtctggtagtcttacggtcaatgccatagtgttatcctcttacattaagatgttggagtaagtatagggtggtaataattgtaatacaagtaatatgtggtaacaggtggcaaattaaacgacattattcccctcaatattgccaaaattttaaccataactaaccgcttgcgacttcgtgttgcaagtggcttttgttgtacctgaaatttaacccgatcagaaatggtcgggttttttattggagaaaatatgtggaactcaatcggtgtgccaagtgttcctgggctacccaaaaacattggtgatgcagccataaaattcggtggtggcttagcggtaaatatgttctttggtaactattggggcatatttaaccagaacggaataccgctattactggctgataacgtgaaatccgtgaagtatcaaacaagatcgaagatttctaatgcacctttagaacaaggctcttttgcatcttataacaaggttatagagccttatactgttgatgtgatgatgacaaaagggagtgggggcgtagcagagcggagtgcatttttagcccttgttgatgcgtttgcgaatagcacggatttatatatggtaatcacgcccgaagccatttacccaaattgcaacattattgggtatgactatgcaagagaagctggcgatggagcaaggctgctaaaagtcaatttacacttgcaagaagtaagagaagttgaagtggaatacacggaaacagaagctccgcaagcggaaccaacgcaaaaccaaggcgaagtttctgcaaaagatgttggttctacttctggctcgaataattctatccttttaaaaggaactaaaagcgtagaagaaaaaggcttttggggaacaacgagagatttagctggagatgttgtagaagtgttcaaagaatcaatgggtggtactaaatggcattaaagatttatgaagtaccagttaaaaatatccctaatcaatcgttatcggtggttgttggtggcgttggctttgatattgaacttaatacaaggctgaatgaagagctttatatatctttaaaagcaaatggtaaatctatcttgaataacagaatttgccgagatcgcacgcctttaattagtgtggagtatcttaatgttggcaatgtaaatcttgcttttttcgatacgcaaggcaaacaaaatccacattaccaagcgttaggaacaagatataagttgatttttgtggagcggtaagatggggagttttactgttaaaaagttaagggtaacgatagcactcggacagaaagagcttaattttgatgataagaataatacgattgttgcagaaaatttaagggtatctgccacaatacaatcaggaaatggtgctatacaacctaacgcgaagattatgatttatggtttaagccaaaatgtaatgaatcgtatatcgaaaatatcgtggaatataaaacaagaaaagctgaattctatcaagttagaggcaagttctgatggtgggcaaacttacacgaccgtttattttggcacaattacgtttgcttatcctaactatggctcagcgcctgaggttatcttgacggtagattctgttaccgcaatgaatcatcaaattttaccggcaaaacctttaagttttaaaggcgaggttgatgttgcaggcgttatctctgaaatatgcaaatcaatggatatgcgctttgagaatagtggcgttaccgcaaaagtaagtaacgcatatttgccccaaacagcattagagaaaattacagagctttgtaaagcagtagatgccactgtgactttagatgttaatacaattgctattactccaagagggcaacctcggaatataaaagtcccgatcatctctcctcaaactggtttaattggttatccaacaccgacactacaaggggttagtttgcaatgtttatttgatccgttaatcaaacataacgggcaaatagagattaggaatagcctgattgaatcaacaaacgggcgatggcgaatatatggcttaacgcattacctagaaagtgaaatcgctggtggtagatggtttagtgctattgatgcatcaagattagatgcgggggtgaaaattgcaaaataaattcggacaaatgacggaagaacaaagtagcggaggagttggcgagcttggttttattgtcagcagcttaatcaaccgcatacaaaccgttactttagtgcaagttaaagcggtaaatgcgacaggtgtcgcaccggtcggaacggtagatgttcaaccaatggtcgcacagcttgacggggaaggtaaggctcatgctcacggtgttattcataacatcccttatttccgattacaaggtggtagcaatgcggttgttatcgatccgaaagtcggggatatcggcatgtgtgggttttgtagtcgagatatttcctcagtaaaagccaataaagcaccatcaacgccgcaaagtttgcgtaagtttgattatgcggacggcttatattttggtggatttttaaatggcgtacctgagcaatacatcttctttaaagattcagggattgatgttgtcgcaacaggtgaggtttatatcaaaggctcatcaatcaagcttgatgcaccagttgagactacatcaaccattcaagctaagggtgatattactgataatgcaagctctggtggtaaatcaatggctagtatgcgccaatctcacaataatcacactcacggcggtgggtcaaaaccagatacaaaggtataagtaatggacacgatatttttaaaccctgaaatatgggacttaatgttagatgatgaagggaatatagcttatgcaaaagacccttatgcaaaggctcaagatgttgcgagtgccattaagctctttaaaggtgagctttactatgataaggcaaaaggtatcccttattttgaggaaacgttaggcaagaaacaatctcttgcgttgtatcaatatcggttagagaaagcagcattatctgtacctgaagttgtttcggcaaaagccattattcaaagcaatgtggatagaacaataacaggggcgatcaagttcactgatgataaaggaagaaaagtagaggttaatttatgacaaatgtaccaaacatacaatttacgcctcaagggttaattttgcctacagagcaagaaattttaaacggtgttttagcggattttaatgtcgctttcggtggaaaccttaatagaaacttggaaaccccacaaggtcaattggcaagctccatcgcggcgattattgcagataaaaataatcaaattgcttggttggtaaataacctggaccctgattattcggaagggtttatgcaagatgcgataggtaaactctattttattaagcggaaagggcagattaactcaacagttgaatgtactttttatggacttccaggaataacgattccaaagggatttattgttaaagacgaaaataataatgactgggtattagatcaagagatcagtatattgagttctggtcaagttgtcggaaatcttacagcaaaaggtatatattcagctgctgctaatagtgtaaataaaattcatcagtcaatcttaggattggatagagttgataatcatagccctgctattacaggaacagaaaaagaaagtggttcggaatttgcagaacgttataaaaaaagtgtagcgaaaaattctttaggaatgcctgcttctgtttattctaatgtggcttcattagatggtgttgttgattgttatgttattgataatcctaaaagcacagaaacaagaataggaataacaaataaagtgttagagcctcatagtgtttatgttgcggtattaggtggaaatgatcaggaaatagcaaaaactatatggagatatgctggaaatgggtgtgattttactggtgacacaacagtgaatgtagaagatgatagttatacagttcctagaccagtgtatgagataaaatttatgcgacccaatttgacccctatttattttcaagtgaagttgcgaacaggttcagttataggaagtgcggaactagttaaatctacaataaaaaatactttcgataagcaaaatcgtaggaaaattggctcaacgctttacgccattgaatttgtttctgatgttgttaatgctttacctaaagatcacctgctggatataaaaatagggaaaagcaaatctgtatatgcggattcaatcgaattgggaatagatcaatatccaacactcacggagtcaaatattagtgtggtgtttatatgatacagctagaaaaaacaattattagccaatatgcaaatagtccgatcataactagtctgctgaagaatattaatgaaaatctagatccgagagttgatatagagggattttataatttaatttggaatcttgatacagctagaggtataggacttgatatttgggggaaaatcgttggcataaatagaaatatacaagttgatgagaaaaatcagtttgttagctcaactttagcaacagaagatttaaaggattttgctgttggtactcgacatctaatgaatgatgaaatgtatagagcaatgatatttttcaaagcaatgagtaatactatttatgcaacagctccccatataaataaattagtgtccagtctttttgaaaagagaggaagggcttatttcattaagaatgggacaatgatggcgagatatgtgtttgattttaatcttacacctattgaaaaagctgtcattataagtacggatttattacctagacctacaggtgttttagttgatttctatgaaccagatataaggaatgcatttggttttaatgaagcaggtatggcgccttttgggcaaggtgctttttatataggtgatagatagattaattaatgagtaatacaagcctgtgaatttatttcacaggcttttttattggagtaaatatggcacaaccaaaattattatcaaaaatttgggctagtttaggacttaaaacggatattcctgaaactagaactagagatttggcacaaagtgctgctacatacgaggagggctttcctcagatcacaatgaccccaatcacacaagggggaaaagcaccatctggtaaagatatgaacggtatattaagagatattacggagcatatcgtttaccaaaacaaaggtggaaaatatctgttcgatgcttcttttgcagagaaaattggtggatatgagaaaggggctgtattgattactaatgattttactaaatttatggttagtttagtgaatcaaaataaagttaattttaatacctcaaactatcaaggcagttgggctgtcattgctacaattgatttggttaaatttatcacaccaaaaagtataacagcaacgagtacaaatactactgacagtacaggacattctcacgcaattgacacggcaaccacatctcgcaaaggaattacccaactcaccaacgacacagggctagactctgagtcactggcattaaccgcaaaagcaggtaaagctattgctcagtctgtggcacagttgcaacttagtacaacgaatgcactcaatcaaaaagtcaataaaacggatatcagtaacgctgtcaattcaacatctcaaactacggtggcatcgtcgcaagcggtcaaaacggcttatgatttagctaacagtaaatacacggctcaagatgccagcccaacccaaaagggcttggtgcaactcgccaataacttaaccaccaatgatgctacaaaggcgttgacggcagcacagggaaaaatcttaaaagatgagattgatgggattgagattggggggcggaatttaattaaaaattctcgtctattaaacgacactacccactggaatgtaattggtggaagggatgttagaaatggaatcgcagttttaaaaagtttagatacatcgagccaatggtgctggagacaaacttttgatttgcctgagaagcaatatacatttagtgctgaggtcaaacccgaaagaactgcgttttatctccatctgtacaatgggaagagctgggttaattttcatgcaagaaatttgactccaggcatatggcaaaaaatatcgattaccttcgttagtgcgataagaaacatttcattcattaatccaggtgaaggacttgtagaattacaaaatcctatgcttgtcgaaggcaatagagctatgacttgggctccagcgcccgaagatttaaccgaagaagcgcttaatagtgcccgtcaaaactatgttgccaaagctggggacacaatgacaggtaatctcatgattaaccatgcagtttctcacgttaaagggcaacgaaatagcgttgatacttggtatgtgggtaatgaaagtgggagtaatcaagatgttatattaaattcttatgtccatcatacctacattaaattgaaacaagacagagttgaatcgaacaaacctatctatcgaggcaatcacctcgtgtttgacgaaggaaatttgcttcccgttcgacagattgatttgcgttctattgctaatgggcaaatatctttccaagatgctacgcctgcgcagttaccgcttggagctttcgtggggctatctaaaaaatctcacttgaatggtgcgggcgatggctggatgatgattaacaaaggctggccagataactcaggagtatttgcttgcaatcgtattggtatttcgggcgatagaatacgcttccaaactgcaaataatcttaatgcttgggggaatgtaattgagctggccaatctcagtgattttatctatcaaaaaatcggcaattttgaaattcgcaaataccctgatgggatgatgattcaaacctatttttatgatgtaaatgatttgaaagaatggggagaaaagcaatttacttgggctgtcgcttttgctgataaacctatggtgatacctaaagtggagcatacctatggtataaacagcgatgttggtagtgctattatgagaaaaagcaccaatgctgtttgttattataaattatatgaacaccacagtgaggatcaaggtgactgtcgagtacaatttttaggtattggtcgctggaaataggagaatacaatgacactttattacaaaaacggcttttatgacgacagccacggcggctttgtaccagagggcgcttgtgaaatttcggcagaaacctaccgcttgttacttgaagggcaagctcaaggtaagctaatcattgccgatgatgaagggaatccgattttaagtgagccaccgccgatacctattgaagaacaacgccagcaagtccgcaacgccatcaacaccctgcgagataagaaaatcaacggcggtgtttatgtgccagcgattgacaaatggattgacacagacgcaacagcagagcgtaacatcttgtctgtcaaagcgacttttgacttattcggagaccaagaaattccttggacttttgcggataattcggtggcaatgattaacaaagaaaaattgttagtcatttggcaggtgttaatggaagccaagactggcaatcacgctaatgccttgaagcataaggcgatggtggagcaagtagaaaatccgcttgaatatgattattcggatgggtggacgcagacttatgaggaatttgcaggagctgcgaatggataaaatctaccttgcactttacaaaggcaatgccaaaaactggcaagcccgtttggaagattggctgattcgcaaagcaaccaaagggcaatactcgcattgtgagattgcaatacataaaagtcgaattttcgaccattatcaccaagaagaatggtttgagtgttatagctcaagcctccgtgatggtggtgtgcgttgcaaaattatcaacgtatctgaccgctctaagtgggatttggttgagctaccaaatgtgacagaggctcaaattagattttactttgaaataaccaaaggtaaaaagtatgacctttggggagcattgggtgtagtgcttggatttaagcaacgtggagaacggttcttttgctctgaatggtgttttaatgcgatttttaatagcgaacagggctggcgatttagtccgaatcagttggctattttattaaaataaaagcctccattgtggaggcttgtttccagacttgcgagttagatcgcaaaataatttcttagattaatttttgggtattatgattgatattacttcataatcaaccatttaacaaatggtattaaaatcaacatgttactcttttaaatctattccagctagttaagctattctcaagttaatacaacatttcgctataaagctctttaggttcatagccgatattaaatctaatttgattattagcttttgcgatttcgagtgcttctcttctatctacaaaacgactgaaattggttaaaaatccctgttcttttttccgccattcatcgtattccatattttccttgatgagtctgaatgtttggtcataatgccttatagacgggataattatttcaatacttgggtcagtaatgttgaatagttttattgccgcacatacgactaattccagatgcttttcaggtgatttcataaatcttcctccttaacaaacacgccatcaatcattttgccttttctgtctttgatttggtcgtaggcaaatcgagtgcaatcaataatgtcaatctctttggctcggcaataccgcattaggttgtaaaaaatcatatttactgattctgggtacactttttctgcttcaggaacgccgtagtcagaaagaaaaccaagaaaacgtaatatccaaaagagatgttcgtctgcgttgaaaacgttatcttcctcgtagatgtaatctgaatctaggtaggtgtcataaagcgtttcttcaatgttgagcattttgcacagattagttaataccacgacactatcgcccacgctatcacggattttgtcagtgtcgtttttgttatgcccgctgaatagctcaccgacttcttcagaaagcttaaagatttgtttttgtacggttgatccgttgatgatattacggtcttccgcccattgttcgatttgttggataagttgtttcatttggttttctccataaaataaaaccgcccataaagagcggttggttgtggttaaaagtttgctaatcgttgttgattaagctggggtagggcttgctcaatgaatgggtcaagccatacgttaaattcgtgtgcgatgtcgtagcccttggcgacaatctcgtttttcagagccactaacaatatgaagatccgttagagaataaagattttcgtaagtacgaatagatgtttttagaatggttaagtttgacatattatgccccttgattttcagttagtctttcgatcaaccttagtagggttgatcgggcttcaactaccaaatcaagctggcggagcttatttcccgaaggtattttattaggctctctcgacccgaccactgaaatcctcagatctgaggaattacaaattttaggcataaaaaaaccgcttttattgtcggagcgagaaaccgacttgatttagtagtgcggttatcttaatccgaaagggcggtttttgtcaataggatttactcgtccatcaagtcttttgttttttgtggaatatctttaacttgtcctttaattccatcaatcgctttatctaagcgttttcctacaccgtctataatggtttcaagtggtgtagagtttaaatctcgctcaaatacttttgttggatttgaacctaaattatcaactgcaatttgtaataattgctcttctaattcaggagactgctcttgtacttgtttacggtaaccttcaaatgccattgcagaagagtatttatagccataatcttcacgcaagcggaataaataggcccgttctttcgatttaatccaagcgacaattaagaatggcaaggatatagctgatttggcaaagaattgcacccaatcaaattgggtgtgaatttgcccttcgggtaaggcgtgggtaattaaacttgaattaaatccccataatgaaatgcctgcggtgataataagtgctccaattagaaaaccgtctgcccatttcatctttgtgttaatgtcgtccatttgttttttgaaagaacctgccatacttgctcggttggcatcatcgatgatttcttgaatatcttgtttctgtttattgaataatttaatcatttcttcaatctccttatggtattgctctattttgggtttattggtttcaaccgtgcttgcaaaggtggtgatcttagcaaggttactttcagccgttttggcaaaagtggcaatatcaacacagtgttcgtctgctgtgctataccattctgcaatatcgtcagtttgaacttttgctgctttgtaggacttttcgagtgctgagagactggtttgtaacttttcaaattcagccttatctttggtaagttgattttctaaggcaatatgttcagtaagatttgctttaattttcgtaatatcggctgagatagcttggcgttcttcttctgttcggaattcacctttaacttcaataaggtaggtttcttttattaagcgtttgaatgcgatgagataaccaataaagcgagtttcttcgttactgcgccattctgtttttgttgttaatttcgatatattgttaataagtgttagagcgcgtcttttaaaaaaggcaatttcaatggggttatttatttcagtaaatttatctatttgattataaatagtttcaatttcattaagtatattggcgagtgtaattgtttttaaaaaaacataatcattattgaattcctgttcaatttgatgttttaattttgttaatgctgttttaattgttttcatttcatatttccctgaaattcagatacaaaaaaagccgttggtggacggcttggattgggataatgttaagctgaattgggggcggtgtcaatatggaataaaaaagcctacgaggtaggcttattcattctcttgttgttgcttttctaaaacacttgctttgcctcgtccaaatcctgcccagtaaccagcaagtaatgcaccaccgatttttagcatttctaatgcaaaatctgttttatctgtgtacattgcaataaccacaataattgtgataacaacaacacctacaccaattaagatatggcgttgtgaatgaagtttagaaactgcagtaatttgttgagtgcgatcgcctttttgagcttcaatacttgcgagtgcaattttctcattagattcaatgcgtttccgttcaagctctaattccttttcttttacagcctgattcgcttgttgaaccttcacaagatctcgcattgtagcaagaagttgtgcgtccgttggttgtgggtttttattattcattaacgtactggacaaagctgtggcgttttataagtgatttggaatgaaccataaccaccagagccaattttaggtggaacaaaagtaacattctggatgttgttacttactgtggattttctcgcttcgtttaagtactgtttcgctgaaacgttgcgaacctttttaggtacaagcagtggcgttttagtcatatgaaataccttgtttgagtgatgaaaatcccttgtgaaataaggattttatataaaaaaacacattgaggtggttgtaaactttctgttgaaagcacggctatcttaatccgaaggggggcggttgtcaaatacaaaagcctgcggaaatagcaagctttgtggttattgtttgggtttatcttcgtcaatccatttttctgcaagccattcaaactcacaaaacagtttattgttgttatttttaatacgacgcaattccataatatagggtttcaacgtattccagtcagtgattacgctacttttactcattcgtttataaacggcttcatcaaataaattctctttgatgccaacacaaataaattcaatcgagttgagaatatcaagtacgatgaaattttgtcgatttgtttcatctgttgcttctgcatgtttttcgagggagcaagctaagctcgtgaagtttagccccccatcacgcattttcatataagattttcggcgtttgcggtaataggcattattgctattgctgataagtaattcgatagttgctttttgtttgtgctgttttcgtaattctttcagttgtgaccacgcaaaataggctaggtaacctgtgaataaacaagttcctagccctacaagcagattaatatcaaagttaaagttactaaaatataccagcatttcattggtggtaggttgaggcattaaacttcccatccttcatttagtgaaaaaccgtcccaaccttcgttaattgatttagacatttcattactcctaatttaaaactaaaatacacaaaaaaagcctgcaaatgcaagccctgtcacgttccgtattttaaaaaagcactttctgttgaaagtgggggtatcttaaattaaagggcggtgggtgtcaattagattttattcatcgaaccattgagtttcagaattttataaataacaggctcttcttcgatatattcaaccaatacatccaccaagaagattttgtgataagggtattcttcgttgatgatcatggtgtctttaagtgatttatcttcaaatcgcactcttactggctttgatgaaatcgcagggataatggctctgtcgtgagctttgctttgagcgtctgcggtggacgaccaataaagcgtggtgtttcgtaaggtattttcttcacgctctttgaggagtttcaattctcggttaatgttattttgagctagccctgccattgcattgtcggcgtgtagatgaatatgcacatcgccttgattattcgatacttgtagattgaattgtgctttggggtcgatagcgataggttctaaaatattattggcattttttaacattgccggtgtaagtcgttcaggcttttcgcctttattcattgcccagtctaaaatcattttgagatgtcctccaaattcgagaatggcattaccctgttcaattatcgggtaggtgcttgaaaccagtgcggcaagctcaacaaggaaacagccttgtgtgattttttccacataaatatgctgttcgcaaggctcaatttcaattttgttgtcttggataaattggcggtattctgcagctatcccttccatactttggcaaaaggtagagagttgtagcggttcactgttatcaatttcgatgagtagtttcatatttttgtctattgtgtaatgtgtttcagctaccataccgcacctcaaattttggatacaaaaaaagccgtgttagacggcttagattgagataatgttaaactgaaagggcggtgggtgtcaaatacaaaaacattaattattttagtttaaccttaaaaatatcttgattatttatttggtttaacctaaaatatgcttgttttcggaatggttctgaaaatgagaagcccagctttcactgggccactaaatggagctaggatatgaagattttcagagttctaatcctagttaccgtagtattactcacctgttgttcaggtacggtagtttaaggtaactcctgaagggggaaggtcggatgtccccctgacggctccaactataagccttttggcttaaaagatcaacaaggaatttctatgcaaactgaaaaacgctctcgtggtcgcccaaaatctggtttaactcttcaggaactgcaagcaagaagcgaagctaagcgtggggttaagctcaaaggctttaaacttcatcaagaaacgattgagcttattgaacgccttgccgagcaacacggtatttcacaaacacaggtgattgtgcaagcggttgagttatttaatcagaaaggggcgtaatgccctttattctttcattagcgccatccaaaatagagttttccctagtttttgtttgactacacttaatttcaggttgatgatgctgagaattaagcataaacacgttaatgaaatcaaccagctcatctgcctagtccccattaaaaattaaacccctgcccgtgtgttacgaccttttcgatttcttcgtagcggcggacgttaaatttctcaaactctaatactttgactaggctttctgctttagccttgagttgttcgagttcttgctgttgtttgaaattctgtgcgacaagttctgaaatgtgttcgtttgctcgaataacggcaagggcttgccgtgagcagagtgttatataatagtttaactgcttacgcagtttgaaaggattgagggttttcatagtggttcctttggtcaatcgagttagttaagaattctactttgagcaacttcgatcagtagtttgtattcgtgatgggtcttgtcatcgtggacttcttttgattttgataaaaactcgtccaccgtgcctgtaaagcaaccacgagtaacaattaacccaaattttccattaaagaccgtaagcgttccattttctgagcctacattacttgcccaaaaaatcattttgcgttcagagataactgcaaaagatctcacccgagcatcaccgaacacccgagcgatatcgtacacccgagcatcaccgcacaccccagcgttaccgtacacgcaagcgtcaccgtacacccgagcatcaccgaacacccaagcgttaccgaacacccaagccttaccgtacaccccagcgttaccgtacacgcaagcgttaccgaacacccaagccttaccgtacacccgagcattaccgtacacccgagcattaccgtacacccaagcattatcgtacaccccagcgttaccgtacacgcaagcgtcaccgcacacccgagcattatcgtacacccaagcattaccgctatgatctaaattcttttcggtttcgatataaccgcctaattggcctgctccaactaaaccaaatgtaataagtgctttaattcgatagagcgttctgcctaaatgttctactgtgtcatctttgagtagttcgtatttcttttgtgtagtttgttctgtcatttttaatttccttgcaataaaaaaccgcctgtattgctacaagcggttggttttcgtgaaaatgttgcaataaaaaagccaccgtaaaaacgatggcttttcttaaaacttcttgagtttgtcagtacactaatctataatgcacttgttttcagcaatggtgctgaaaacgagctgggtccgaccttaaatctaacccaacttttggagggataacatatgctttaccgcattatcctagttatcattctcttagtaattagcttgccggcttactaagttgaatgaactaagcagggggagaaatctccctgctcttcaaaactgatattaaggatttattatggcattgtcaagaagtgagattgtggctcgcagtgatgcaaaaaaggggatgcaagccaaaacctataaacttccgcaagcgttggtggctgaaattgagttgttagccaaacagtgcggtatctctcaaggattgttaattgctcaagccgttgagctgtttaagcaatcgcagaaaggggcgtaatgccctttattaaaacgccctcaaaactaagggcgttgccattaattcactttcaacgccttcagcgtttcaataaattgcggaatgtacttatcaaaggctttcatcaacacaggatcggggttttcggtgtggataaaaagcgtttgtttttgatattcagggcagtagctgacaaaatcccaactgtcataacccgtaacccataaggcgacttgtacctgtatgatgtactcgctgggtaccacgccctcaatgatatatttgatgtgggttttcattttggggcatttgatttctaagccttttcgtaaggttgggataagtccatcggggcttaccatcatatctttgtcggcattgcgatatacaccaccaacctgaacaacatcattgcctgtggcgaactcatacgccattcttgcttgttcttcaagctgattacctcgcaacatatcgctggatttaaagccttctgttaagccctcaatgctttctgcgaccagttcggcaaggtagcttgtccacgcacttgattttttaccgcttggggtgacgatatttgacacccctgttgcagtaggaatacctaatcgtgcggtgagccattcttctgtgccttgctcacagttgagtgtgattaggttttctatcataacggtatattttcccctaggttttcgctttgtgcatgtgatttatcaacacgctcattcaagattttgattaaatgttcagctttgtctttcggtagttgatcaaggctgtttacaccatagtacgcaatagctttggcgacatcggtttgtgtaatttggataagttgatcgagttgttggcgttgttcatcagtgatcctaacaacgccatctacatcgattacggtttgttgtggtgaagctggattaataggctcttcagttatctcatcagcagtgattacaccgcccaattcatcaggaaatgctttacgcaatgcacccgcttcagcacatttagcaagctgccctcgagggcgtttcgtccacattgaattaactttatattttcctgttcgttgtttgccttcccatatttctgttattgcacaggcttcagtaaaatactcagtatgagaaaatgcacagcgttcaccattaacaaaacgataaacagttactttgcaccattcaggagcattcacaccaagatattctatagtatcgccaaatacaggatcatcttgccctgccatttgcctggtacgaaatgctgtaattcgttgttcataaatacccggcataattacatcacgccattttttttctcctgtttttgcatccgttacgctcattggcacaatatgacaaggtttcttgagaatatccattttacgagccttgcaataatcaatcgcaagtaaaatactttcgtctttcgcaccagggaaaatgctgttttgtaatgtactccatactgcgtggtctatgccacgttcagaaagtgcggtttgaatgttggatggtaagtttgttgtcataatttatccttattttgctttattaagtgaaacacaatccccaaacttcgctttaagctcacgagcaatattaacagcttgggattgaatggtttgatttaatcgaatggttatcacaaaatcccctaaaggctctgtggtttccgtttttgcaaaatcctgtggattttcgaccgcttgttgctgtgccatttcatctgcaatagcttttgcctccgcttgaactttttccgcctcagcttttgctttagcctcttgttctgccttggctttaatttccgcctctctctgttcttcttcggcaatgcgttgctgaatgattggctctaactcatcatctcctgcaatcaacattaaccagtctttaaacaggtattcgtaatgaattggaatgagctttctgcgtgcagaaattcgagctgcctctgctccgatttctgcggtaatggcggtttcttcggcgttcaccgcacttgttaaagttgccagtgtacttctacgtttagtcgcatcttcaaggcgttttttgatattttcctttggaatattacgctcaagggcaagcgatacatcgctttcgtgactgcctttgattgttaaaattcgttcaaaggcttgagagataatactttctttaatctctgcttttcggtttttgaccactttttcacggtttaaacgttcttgtctgaaacgttcagcgatttgttctgctgtcgaaattaactctgcgatttctccgctatgcgtttgttcaatcgctgtgcggattttatcttcaatttctttaagctctttcacttcgctatctgccttagcaaaatcgtcatcggtttcaaaggtggtcgtgagcgttgcaaggtaggcgttagcttgttcttcaaaggttttgatgttggttgaaaggactttgctttcggtggatagaattaggtctagcattttaaaatctctctttagtcaataaaatgattaatatcagggtctttacaagcttttgcataacgtttccagacgggcaagtctgtgtcatcgtcatcatccctgtcgtattcgtaattttcttttgcgatagctcgttcaaggtcgtccattctgttgctcctgtgttttcttcaccatttccgctaatgctccgaacatctgcggttcaagtacaatcgtgttggcgttggctcttctgtctagcattaggcggacattgccgtttttatctacgagatagccatttaagccgtaaggggtaaatggttttcgtttgggctgtgatggcttcggcttcggctcaacttgttctgttggtgctgtttcaatctcaacttgttctgttggtgctgtttgctcaacctgctccgcttcgataattgttccttttagcccaacttttttagtttgctcaattacaatcgggatatgccctttgatttcagggtagtgagggatagctcttttaccgactaagcctttttgactgttatatctatcaatggctttgtttaaatttcggatagcaagaatttccgatgtcattggtacgccttgaaactctagatgtttatccacccacatttcaccgaagtattttttatttgggttttgtaaaatttgaagtttgatcatctttttgctcctacaatcagtttgttaagttggttttggttatgttgtttaatcagcttcacatcttcacctgtaacgttatcaggcggtggaagatgtagagctaatgcgttgtaatttacctcttcaggggtgatttcagcttgtttgaagtcatcttccgtccaaatcttttctgcttggaaattgctttctacgggcagagtagagacaagctcaggctcttcacagccagttaaacttccgcctgtcacaaaggcgataagcaaggcaccgagtaggtatttcaggttgagttttttgataagtgtcttcattttttattccttttgttgaattttgggtgtgagaaaccaccgcaggctttcggggaaagtgcggtggggttgggttttgggtttaattaagttttaatcgtgatttgatacgctcaaattcaatcgggttactttccttaaacggttcgataaggcgtttaaggattggtaagttttcatcaatgaggcgtttgtactctcgatgatggctgtacaccgcagggtggaagtttgagccgatggctgctaggggttgttcgagttcgcctagtaggtcgttcatattgcggtgtgagataagtaaccaaacgaggctgtagatttccgcaccggtaaacgatgccggatagcggacttcgggttttacaagcggttggttttgttgttcattttgcaaaatttcacggtcgagaatatccagcacccatttgcggaactctttggcgactttggttcgggcgaacattgcgattaggtgacaaccacgcagactgaaaattctctgctcaatttggcggttagaaccgttaatgccattcgtagtcaaattgactacggttgtcatatcggcagtaaattcatcagcatttctttcataaattttagcaatagaattagtatgttgatattgtaaagctaatgctaaatcacttgatgaaatataagtttggttgttacgttggatcgcagttaatgctacgttttggaaagtaagttgatttgacataattttgtacctttcgttttagttcagtagtcgatcacttagtaggtgatcgggcttcaactaccaacgaaagatggcggagcttatttccacaagggtattgtattaggctctctcgacccgatcataactgatcgctacctaaattttaggtacaaaaaaaaccgctttgtatcggagcgagtaaccgactttcgttgtgtagtgcggttatcttaatccgaagtagcggtttttgtcaatgggatttactctgtttccgagattttaaattgaacagcaacgagagagtaatcatcaataggtgatttctctattcttttttgtaaggttgctgaaaatttcacaatgctattcatcgttttttcagagaagcgtgggcgatgttcccaaaaatgatgagcaccgtctgacataatgtagatggagacctcattattctcatccttaatttctgacatcggaataaagaattcatctggtttcatttcgacttgtgtagaaattgccgtggtgatgacattttttcctgatagctcttttaattctttctttgtatagattttttcatcaaataacttttgatgagttgtgtgatctttcgttttttggcgaagtttattaccttgctttatatatagacgacagtcaccaatatgccctatgcacaatccttcttgtgttaaataaccaaatgttaaggttgtagatgcttggttatattctgggtcaagttttttaatttcagccaaactagcggaaaatacattattgtaagctagttctaggtttttgatcgcgattctggaggcaatttctccgcctttgtatcctccaacaccatcagccactgcaaataagtaaccgttattgtgtttagtgcaagatagaatatgatcttgattttgccgtatttgttcttttggaaaagagaatgatgcactagcaattaagttaatcattgaattattcccccatcaaatgatttatatcattaataatttcttgcactgacatatacctatctttaggttttctagctgtacatttttgcatgattttatcatatttagagtctagctgtaattcttccattacaacaccgatagcaaaaatatcagattgtattgaataatcaccgccacttaaaatttctggcgacatatactgtgatgtccccattttttgtccaatttgcgtaagagcagtagatgcactatttagatttttgattaatccaaaatctgagagcttatattctccatttggatattttagaatgttttcaggttttatatctctgtgaaggaacccttttttatggagataattcagtccagatagcaccattttcaatatattcaatttgtctgaataactaagtctttgagaactatccaaatagctgtttttctcaagcgtatctgctaaactttcttctgcaagttccataataaaccaaggctgttctccaagagaatacatacaaatatggacaatattactatgaaaacattctgcttgatatattacttctctcttgaaacgttctttatattcatcaagttcttgtgaattttgtactctaggtgaaaaatgctttcgtgcgaattctttagatattgtttttgatttattatagacggcaactctttctaccgttccaaaactaccattaccaattttatcgacaggctttatccaataatttctaaattcttccatacgttttccttcagagcagatacaaaaaaagccgttggtagacggcttgaaagtacagttatcttaatccgaatgggccgtaggcgtcaatcccacagactgaaatccccttgtttagcgggtgatttttcgttaagcccaaagcaattcagccaatcgcactttttctttaaattcattgacggattttttagcgtacgtcaatgaataagaatgttctcgtttttcagggaatttttttaggtccgaatgtttgtcttctgcctcttttagcttatgtttgaaatactcaagactttcaggcatggataaatcaattttttcagccatggattcccagtatgcaattttatcggcataactttcggcttttttcatttcttcaacagccttatccattcttttagcattacgttcaatcaaagctctgtgtcgtttttcgctgtgatgtccgatttttattggctcagcaagacttaaaaagtcacgcccctcattagccgcctcacaatattgattactgcgttttgcggcgttatcagcatattcttgataacgttgtgctttcgctgtggctcgagcttgactatccaacccatcacaacgcacaaaagagtaaaaataaaatcccccttgttgtttaacgaggttgtgtatttcaacctctgtttcattgccgtatttacttgtcacggtaataatttcgttcttttcgtgctgctcttggcattttgctaaaaatacgtttgggcagaactttgcatatgtattcatttttttacctcaaaaaaacacccacctgttacagtgggctaacgtagcggatcatcattatgattacgggtgttttaagtgcttaccgcatacacttttgtttgttgccattcagaaccgctctccaagacaatcaaggagaaaattgtctagtgttagcaagagaacggttttgaatggcgaccgcagagagactcgaactctcaacctactgcttagaaggcagttgctctatccgattgagctatgcggtcgattttacttgcgtttgtgctacctgattcactgccagtgcttaacctttccacaagtaatcacaccgcttgagctatggctttcacatagcttgttgataccatctcacctttggcaagcggtgcgtttttgtctaaattgtgtcgagatgaaataatggaattagccgcctttttggagtaatctacgcattaaccttgctatttttgaaagcgggttttcagggatatatactgaaagatgtatctcgccatcaacggtcgcttgggacattgctttgactttttcttgcgcctcttcaaatgagttggcataaacttctgttgcccacttctttccgccgaagctataagaaacagcatagcatttcattttttcttgcataaggagttacctctatgtattttcaaattttccaaggtgttaatggtcagtggtattggcgattgtgtcgcgttttgtctagtggcttgattgatattattgcaacaagccatcaagcctattcagataaatctgtttgtgaaattgatattatgaatgtcaaactcacaaatgctacaacgccaattcgttatatttaaccttaagtcctgttagagcagggctttaaatccgtatcaactcccgacaactacgtctgattttctctttggctcgaactgttgttggtttgattttgcctttgttgcaagcgtaatttgcaatatcaatcatttttttgcttggtctttcaaggcaggctatatctactcttgaaagggtgttagcggtctgttttttgcgattttttgcgaacattctcgctagtctgccagctttacccgttgtgcgaacttctgctttttcgcagtatttgttgcttgttgggttacgttcgataatgattttagtcattgccgtgtcctctgtttgttgccattcatagcgacacttgtctaacatttcctttccgatctcaattcgttgtagataaatccgcattgatgtgagatgttccagttctctgtaaatgtcgctatgaatagcaattcctgtttgcctcagccccactggtacaggcgaccaaccttgtttggtgatgtgggttattcgtgttgttaaagagcattgagccgtagctcgttttgatgggtgtataatacactatgtattttataagtaaataccaaatgtattatttttcgcaataaaaaatacaaaatgtatttaattgattgattttaaaggaaaataaattttgtgaagtgtgtttgattgcttgttttttaatcattttcttggtgtcaggaagatgtttttgcaaaaaaatgatggaatgttaccgcttgttgtgagtgttaggtgggggtagttagtgtagtatggagtagttagtagtagattttaggcaaaagaaaaccgccacaaatggcggtttaggtctgttcttctttcattactttctctgcgatgtcaaaaattaatttttgaatggtgaggaagttgataatgaagtaaattaagctaatcaaagaaaacaacaatgcgacagtttctggattgaatattattgtaagttcaatcgcagaaagcgtatggctatgaacaatctgacttattaagaaggtgattgttgctagtgagaaatacatcaaaaagctatttcttacatttgcgatgttttctttgacccgtttaaatatctgtggatttttaatggcacttggattaaaggtacaaacgatccccattccaatagaaaacataatgccagataatgtgtaaatggtgggcacaacagccttatacacaccttcttcgggtgtgtataaggaagatagaaccaatgcacctactaatgtagtaaggctaacgacaatccatttaatttttacctgcattttcaagttcttttataaaaagctccatttgttggaaaagtgtctgttcgtttagttttcccgtatctgtggtatctacttcgacctgttttgttctttgaagttcactgccagttaccgatgtaccattacgagttttgaatgagatattatctaaatcagacacaggtttcaacattgctgaaaaaactttcttaatctgatctggtgagtttttggtcggtttcttaatttgtataagtaacttagcggaaacaagttgactgaaatcaatatcatcaaaatcttcggcatcgacaaagaattctttgatatgttcaactgcaaggtgagtaatatctttaaaccgagaaaccattgatgaccctgaattgtcttgttgcgttgcatcaagatttacactgttatcgttattaggatcttgaataacaaaggatcgaatattacttaaatcatattcttcttttagttcaatcacaggattgagttcgattaattcatttagtagccagtttaggtaggtttgtaagcgtgtaatcgtcgttcttcctggtaaatttgttactacaaaacgattggaaagtaaaaaatagtagtggtttttatagatggcactggtattaagttttgtattgagtaaatcgctgatcgaaaaattggctttttgaaagagcttttcatcaatatgctgcacattatcccctggtgcaatccgtagcattgtggcaaaaaccaattggtctttctctgtattgaagtgagagattaaatcttcttcttttttcgggtcatcttcacttaacagcattcttctttcattgctcgattgtgaattatcgagtttctgctttaataaaaccgcaatttgaagaggtttgctcactgtgttatttacaatttcaaaggctctaagttttacttgtttgttcattttttcttcccatcatctaccaataaaattcaacagttgctacaagtagcttctatgctcaaccgctacgcctataatacgaatgtcttgtttcattgaactgagagttgggaaatcttgatttaatggcactagctcaaaatgtggattgcctgatggtgataactctccaagttcacgataacgttttaaggtcgcttcgccattgccatttactgctgcaacaaaatcgccaggatgtgggcgttttctgacatcaatcaacactaaatccccttcgctgaatttaggctccatagacattcctgacactcgtaaaaaaaacgcatttggacctgcgtcaatttctgtatcaatatagtcatagccttctgagtctctaaaatcataagtttctgtccacataccagcttgaatagagctaacaagaggataagctcgagatttttttacagaagttggggttatatttggatcgaaatcctcaatagtaccatcaccatttaagataaccttattcactcctgttagatttatcatttgagcaacttcatttacattaggcattcttcttcctgtaagccaatgaccaatagctccctgagtcttccccattgattctgcaatatcatcttgtcttagattttgctcttgcattttttcacgtacatattggttccattgttttttcatactacacccacctgaacaaaaattaactaattattacttaccgtattaaatattcaaaatacaaaaagtattttgtttttgactttataaaataccttatgtattattaatgcatttttaatacaggagctaaaaatgaacagaatttctgagttcagaaaagctgccaaccttactcaagtcgaaatcgctaaattgatcaataaaactcaaggtgcttttggtcattacgaaactggcttgagagagccgtcacttagtacagcaaaaaagattgtgcgagtacttaatgaacacggtgttgcttgttctttagacgacgttttccctgttggcagttaatttacccaaaggagtgcgcaatggcacgcaatgaattaagcaagtctgcaatgaagaatgcggacttaatcagacagaaggcatcagagacgaaagatgctcaagcggcagaatatgttggtgtagatgcatcaacgatttgtcgttttaaggcagaacatttagacaaattctgtgcttaccttgattttttagaattggaagtatcagagaaaggtttaaatcgtttgacagacagtgaactggatgccctcaagctatttgcagagaagggcgttcatgctattggaaaataaaaacccacgctgcaacgtgggttagttacggaggttttcacttatgaatgaacatcataccgagttgcattctagcgaaaaatcgtccttttggcaagagatggagtatcgaaagcgatgttatgccgaactagagcgtcgtaattttgcaggtaacgtggactatgacgagatttttaaccagattgataaggatttaagcgatgaatgcagtagtaaaagttaaagaaacaccgatttttaagttaggcgaaaacagacaatcacaagaggctaggaaagtgagtgttgatgatggatttacggcaattccaaatgagcttctaaaggcaattttacgctcaaaagtattgggctggaaaggctcttacttgttggcaaccattcttaaaacgctttcttggcataaagaaagtgattggtttactcactctcaagtctgcgaaatgatgggcattgaaccaacaaaatatcatgtcaatcaactttcagcagcacgtaaagagcttatcaaagagcaagtcttatttgaagatggtaaaaaaacgggtgtaaatctagatgtttttaactgggaaatggtgaatcccgaaaaagtagggagttcccgaaataatagggaattagttcccgaaattgtagggaataagtatcccgaaaaagtagggaacacaaaagaaactattacaaaagaaaaaataaataatacccccttaccccctaaaggggaatcggctatcgccgatgaacaaccgcaagcggtgaaatgtgaacaacattctgcaaaaccagaaaagattaaatcaccgcctatggactatcaggcggtagctgatttgtataaccaagctaatcagaattcgggttcaagattgccgatggtggaaaaaatcaatgatgctcgtcggaaagggattaaaaaattaatggctgagcttagagagccaagtttggaatgtgctgagctgtatttcaatgcgttgtttgcaagcctgcggccgtttcatacgggtgaaaatggcggttgggtggctaattttgattgggcaattcgccctgcgacggtgctgaaagttcgtgaaggagcgttgtgatgtctgaaaatctgcgaaaaatcacttacgaggtcgaggtaagtaccgttggttctctgttgaatggtggattgacggctcaggcgagagaggtgttgagttggttaaaacctgagatgtttttgacgttcaagctaggtgaaatctattcaaacattcaacgccaagcgagcaaggataatctgattgatatgttgttactgagttctgagtacggtgttcagcttgccgatatggcggaaaccataaaatcagtggtgtctgcatcaaacttaacgggatatgctacgaaggtttttaatttctatcagcgtagagaagtgttgaaagtacttgtgagccttgctggtgagttgaatttagctcgtgatgaacagttagatgcgattgcaacaaagggcgttgagcatatttctgcgttgctgaataagagtgcgagtgttgcacctgcgggaatggggagtttgcttgatggctattatcaactactgcaagacaggcataaacctgaatttaaacagcgtttgttgtttactggtattcaagccttggatgacattttgcaaggcattgatgaaaccgatatttgtgtcgttggtgggcggtctggtaatggtaaaaccgaaacggcaattacgtttacgaaaaacattttagagcaaggtggttcggtgttgtttttctctcttgagatgagcagacaacaaattatggatcgtctgattgccagtgcaagcggtgttaattctgcaaaacttcgtaatcctgaatggttgagtgatgaagattttgctcgaatgagtgaggctacaagtgtgatgaaagatcaaaagctctttgtggtggataaaggagctttgtctgttgaagagattacggcgatcacagaaaggcatttggctgagcataaaaagttaaatgcagtggtggttgattatattggtttggttaatcatggggcgttagatgggcgagtgaaccgtacttatcagatcggagaaaccgtagagcgattaaaggcattttctaaacaagttcacgtcccgtttattttactttcgcagttaagccgagatgcagagggttctaccccaaataatgcaaacttgagtgattccaaggcgttagagaatgttgcaagccaaatcattatggttcacaaccagcgagataaggaaacaaatgaacctgcgagatatacgcattggattgtgacaaagaaccgtaacggcaaggttgggactgcttatgttgagttccaaaatggacgatttattgaatgtgatcaggcattggcttgggaatctttccagaagaaaaatgaacaacagagaagagcgaataaggggttttaggtgagtttggattttattaagaaggtaggtgggtattttagaaaagagcaggttggtaggtaaggaggttggtaggtatggagcataagcaaaaatactttttacgcactgagcaaatcaaaaacaatgcccttgaatttgtgaaagcgttgccgatagatgagaaaaagccgttagtgattgatgtgaagcctattactcgtaaccttgagcaaaatgccaaattccacgcaatgtgcggcgatattgctaaacaggtgcaatttaacggcgaatggctaccgcttgaagcgtggaaggttcttttaatttctgctcacgcagaagcaacgaaagaaggctctcgtttggtaacaggtttagagggtgaattagtgaatatccgtgaaagcactgctgacatgagcgtaaaacgaatggcaagtttaatcgaatatgcaacttcgtggggtgtttctaatggggtgcattttaatgacagatggaatttttggggggtgaaatgatggaaattaaatctttttcttttggaaaattaattgcggatttagctattgttggtggctttgtttattcgcacttgtatctcacggatagtgcagtagtaaatgtttatatttgggctttctgggcattttctattttaactttaatgtctgcgtttattaagcccactaagtttttgttcacggaaaacagagccaagcaaatgattataagtgagttaactattagcttggtcttggtttattttgggtatccagtattagctacggtcggttttatatcaactcttgcttatgctggctgtagaactgtaaagaacaacaagaaaacaggtaaacacaatgagtagttacttctgcccaaactgccaatcaattcttaaagactggcgtaggttttctgaaaaagtcagagattgataaggtaaaaccgtttgaatgtactggcttgaagtgcactaagcggtggagtgaggaagaattggaggcatttaatgataaagccgaaagtgaaaaagcgtaaatgcaaatgctgtggtggtgagtttaagtctgcggatagctttagaaaatggtgtagtgctgaatgtggtgtgaaacttgccaaaatagcccaagagaaagctcgtcagaaagccatagaaaagcgaaatcgagaagaaagggcaaagattaaagcaacgagagaacgcttaaaatctcgttctgaatggcttaaagacgctcaggctgtttttaatgaatacattcgtttacgagataaagatgagccttgtatttcgtgtcagcgttttcatcaagggcagtatcacgcagggcattatcgcacggtaaaagcgatgccagagctgagatttaatgaggacaatgttcataaacaatgtagtgcttgtaacaatcatttgagcggaaatatcacagaataccgtatcaaccttgtacgtaaaatcggggcagagcgagtagaagcattggaaagctatcaccctcctgtgaagtggtcggctgaggattgtaaggaaattattaaaacgtatagggcgaagattaaggggttgaaatgattagattgcatatcagcattgacgatattctacgcgtttgggtccgtcgttgggcttctcatcgtgggtgtcgtggttatccatcattacaatcttttatgcgtgaggcaactgctcaaattacaaagtatagtattgatgaactgtcagaggaacagtatcttaagctagatgaagctgtgatgacattacacgatttgaatttggaagcctatcaggtgctaatggcggtgtttttacaggggcaggataagaagaatatttgtcttgaaatgcagatctcaccgagaacctatgacaaccgtttacgcaccgcacgagattttatggaaggggcggtatttggctcggggttgattagactgaagttttaggcgtattgctacgcctgatgttgccgataaatttcacaaagttttttaatggcttcggctttcgttccaccgatttcagcaagtactgacgcaaattcgtccgcaataggcgtttccatacgcacagaaaattgcttaaccttgccttcagcaagcatacgtttgttatattcgttcgcagttttagaacgaagtttgcgagaatgttcagtcattgaatttgccatagttacctacttgattttttaaaacgttggttgtatagtttaggaactgcctagcagtgggggcaaccaccgctaggactttatctgattagtaagctgatgagcttaacacaatcagaattaagaagatgatgatttgataggttttcatcgtcttagttcctatttttagttgagcggtgaaagccgctcttcttatttccgccctattgcgaaaacaaatatattataatttacaaataataatttatcaagaattatttgtaagttttcagattttcattcaaggttatcaaatgtttaacttcagaaaacaaaagcaacaagttgagctaattgagcaattacaagcagaaattgaggaactaaaagcagaaaactaccgcttgagagatttgctttcaagagagtggcaagaaaaacgccgttttatgaagatgataaacggcaaaaagaaaattgccacagattaatcaacaacgattatctgtgaagtcgtgtgaattttaattgttcaaaaagtgattgacgtcgtgcgagaaaagtagtacatttcagctatgcttgcaactcgtacaagcgagagaaagcgaaatgattttgtagccctgatcggaaacggtcggggctttttgtttgggggttaggatggaacaacgagatattctgttaaaaaacggtgaagtagttcaagaaaaatctcaatgtcactatgccgctggctggccatctcgacgtatatcagactgcgttcctcacttccaaaataggaaaatttatccatttgccggcaataatgacgtaccacaagattaaacatatctagtggtactgagtaaatttgataaaggttatcacaatggtagaactaaatattgcgttaaaaaatgccgcagagctttatggtgaaaatcgaccatttgtcgatcctgaaagtggaactctaaccctagcaggttgcgaagctctaagtcgtcttggtattggattttccgaaagtagacttgaacctgatcttttagataagttgcgtaagaatctcgctgctctttagtaaaacctgttgtgagtttttctatgaaaaaaaggtgaagatccttttcgagttgaactaagaagttaaagttatttgcaattttggcatctttaaatgtgaattcaatataagagaaatggctattatcatattttcctatccagtgagaacaacctagtgtgataaaggggctatcaggcttgttaagttcaataagtgtggttttaagttctggtagttgagcaatttctaggatttcatctattttttcaggatgattaactaaatcaattccacctgcatttggtgttggattttggcaatcttcagatccatttgatggtcgatatggaaatttggtataaccttcacgaaagtacataatttaatcctctgctagtttatttgttggggaacaatattctagcagtttttttaaccaagctcagtctttacggactgggcttttttattgcctgatatgagggctaaggtatgaaaaatgttatgagagatatgggaacacagacgtatatttggtctggatttagtgggattattgcgtggttgagtgagcaacagaatttaatgattttaagtcttgcgattggtattgtgacggcgtgtgcgaacttgtatcaacgctgtgacgaaggtaaggcgaagcgtcgtgaacgtgagcgagccgaagaagctcatcaaatcagaatgcagatttatcgggtaagggcagagaggttaagtaatgagcaagctaaaaacactaggtaaagttggcggtggggtttgttttgtcagtgccattattgcggtgttgaatacagattttcacggtcaatttcgtacaagtcagcaagggcttgaaattatcggtgatgcggaaggttgtaagcgtgagccttatttgtgtcctgcaaatgtgcttaccgttggcattggttcaacggaagcgtcaagcggtaagattgaaagaaaagtttacacggacaaagagattgcagagcgttggttggttgatattcagcacgcagaaaaatgcgtgaaccgttacgcaaatggtggtgatattccgcaatcggtgtttgatgttgctacttcgctgacgtttaatgctgggtgtggcacggtgagtaaatcgacgttctttcgtaaaatcaaatcaggcgattatgttggtgcctgtaatgagttgcctaaatgggtttattcaggtggcaagaagttacgagggttagaaatccgtcgtgagaaagagaaggcgttatgtttagctgggttaataaaatcttaatggcactgattttgggcttgtgtgtgtggctatggggtcagtcacagaggatagatagcttgaaagccgagaaccaaacacaagcccaaactattgagcaacagcaaaaagcaaacaataagctgacaatgcaactgcaacaagagcgacaagcggtggaatatcagcaaagtattgcaaataaactacgaaagcaggtggagcagagtaatgaacagattaaagctattttacagaaagagccgtgcggcgttactgctttgcctcgtcctgttgtcgatgagcttaagcggttgcacagcaaagacaaagattgagtatttatatcctccgcaagcctttttggtgccgtgtgagcggtcagagtttggtggcacaacctatggtgatgctatcgagtatctcgttaaggtgatgggagagcgtgacttgtgtgcgggtcagattgatagcattagagagtggcaagcacgaactaagcaagggtttaaatagctgattaacgtttgtgtcacggtagagagcggtcagatgatcgctcttttattttatgtaaatcaaatgctacataatttgcgtatgggttttgggattgttggataaatccccgagaaaatacgcaagtgatgtaatttatatataacaaaaccccgatcactgcaaatgatcggggtttttcattacccattaaagccgaatgagtaacgatttatggagattatgacagttttaaccgtaaccatcaaggagatacttatggaatatggtttatggcaaataagccttgcagtaacactacctattttagcgtttgtttcaccaaagctaattaatgccattgctaatttattgaatgttttgaaataaaaaggattaaccacgatgacgaagaaagacgaggttaaatccacgtctaaaggtcgtgggttaacacctaagcaagaaaaattctgccagctttatattgagcttggcaatgcgagtgaggcttatcggcaggcttacgattgttcaaaaatgagtaatgaaacaatcaatacgaaagctaaagaactactgaagaacggtccgattacggtccgattggatgagttaagaagttctcatcaacaacgtcataacattaccgttgataacttgttaggcaagctagagcgtatctataacgaggcgatggagcgtgatacccctcaattctcatctgcggtaaatgcggtaatgggacaagctaaacttttaggctttgacaaacaggttatcgatcatacaaactctgacggctcacttcgccctacggttattgagttggtggcaccaaatgaaaatacagcttaatcttcctcctaaactgataccggtgtttacacagcagaatgtgcgttatcgtggtgcttatggtggtcgtggttcggcaaaaacacgcacttttgccaagatgactgcggttgttgcatatcaacgggcaatgcaaggcgaaagcggtgtgattttatgcggtcgtgagtttatgaactcgttggaagattcatcattagaagagattaagcaagccattcaaagtgaaccgtggttagcaaatttttttgatgttggtgagaaatatgtacgcacaaagtgcggtcgaatttcctatatttttacaggtttacggcacaatcttgacagtattaaatcaaaagcacggattttacttgcgtggattgatgaagcagaaagcgtgagcgaaatggcttggcggaaacttctgcctacggtgcgtgaaaacggttcggaaatttggttaacgtggaaccctgaaaagaaaggttcggcaacggatttacgctttaggcaacatcaagacgaaagtatggcgattgttgagatgaattatagcgataatccgtggtttcctgatgtattagagcaagaacgcttaagggataaagcccgtttagatgatgcgacttatcgttggatttgggagggggattatcttgaagaaagcgaggctcaagtctttagaggaaaataccaagagcttgagtttaagcctttacctgattttgaaggtccttatcacgggttggatttcggttttgctcacgacccaaccgcagcgattaaatgctgggtgtttaatgatgaattgtatattgaatatgaggctggcaaagttgggttagagcttgatgatacagccacatttttgcagaaaggtattgctggcattgagcagtatgtgatacgagcagattcagcaagacctgagtctatcagctatttaaagcgacacggcttgcctcgtattgatggcgtttcaaaatggaaagggagtgttgaagatgggattgctcatattaaatcctataagaaaatctacattcacccacgctgtcagcaaaccttgaatgaatttcgtttgtatagctataaaaccgaccgcttgtctggcgatgtgttgccaacattagttgatgcccataaccactatattgatgcgttgcggtatgcgcttaatcctcgtattcagcggaaaggggattttagccaaaatccacttaaactttactaaggataatttatgtctgatgtttctattgttatgcgtgaaatcagggcgttgaatgaaaaaggtgtgatgattgatgatttgcttggcggaacaaaaacaatgcgacaagcagggaaaaaatacctttatcaattcagtcttgaggaagaagaggcttataaaaacagacttaaccgctcaacgctttatcctgctttatcggaaacgctctaccaaatgacaggtagagttttttttgagccgattacgacaaataacgttcacgataaattaaagcaagatattttgcctgatgtggatttagagggaaataatgtcgatgtattttcttctcgttggtttaatgcaggtttaacttacggcgtggcatggtgcttggtggattacactcgtactgagaatgttcgtaccattgccgatgagaaagccgttaatgctcgtccttattttattttgattaagcctaaaaatgttttgggatttaaaacggataaaatcaaagggaaacgacaaatcacgcagtttcgctatatggaagatgttgcggtagatgatggcgaatttggcacgaagattgagaagattatttatgtgtatgaaatcggtcgtatgcgtaagtacaaaaaggcagatggtcaatggacgctgattgatgatgtgcaacttctggctcaaaatcgaccgcttgaaattgtgcctgttgtaccgtttattacgaaagaaagtggagtgcttgcgttaggcgaaccaccgttgcttgaattggcttatctgaatattaagcactggcaatcacaatccgatcaggacaacattttaaataccgctcgtgtgccgttattagggattttctccgatactgaagtcaataagctacaagttggtggcagtgcgttacatttacccgcaggttctcaggttgcttatatcgaacattcaggtaatgcgattaacgcagggcaagagagtttgaaagagttggaaagccaaatgcgtgttgccggggcgaaactcttagataaaaccgtgttagcaatgacagacagtcaagccaaagaagagcaaggcaaagaaatcagtttattgcgactgtatgcgaataaatttgaagatgcgttagatttagccttggaatatgttgggttgtggttgggtattgatgatgtcggtaaggtggaaattagcggtaacattgatgacgatctcgatccaaatgcctcgatggatatggtcattaaaatgcaacaagcaggcacactttcaaaacaaaccgtctttaatgaggcgaaacgtcgtgggttgattagcgataatgtggaatgggaagatgaacaggctcgcttaaatgaagaaggggtagattatggccttgagttcgcaggacaaaccgaaacaaagcctgaatagtcgtattgcatacgcattaactgatcgcaaaattctgcattttcgttatgatgcacatcttagacagcaggtaatgaaacggctaagtaaaacacaacgtgagttgctcaatcgtttagcggccgcaggtgtggatgctttacctaaaaagcaattagacacactgcttaaggagcttaagcaagaagtggcaaaagtctatcaagaaatgaccgcttacacgcaagacgagttaagcggttttttcacggcggaaacccaacatattcatcagctttacaatgatgaagtcggctttgatttttttaatcaggtgcctgaatataagcaaaaagcgaataaaaccgcaacgattattgcaggttcgcctttagaagactggtgggcaaagcaaggcaatgattttgcctttaagtttgagggaattattcgccaagggttgttagatggtcaacaaacaagtcaaatgattagtgatgttaagcatttaatgaatacgtctcgcagacacgctgaaaccttagtgattactgcggtagcgaaagtggcagataatgctcatcaagccttaagagatgaaaaccttgatattttggcaggagaaaaacacctttctacattagacactcgaacatcaaccgtatgtcaattaagagatgggttaatgtgggatttagataaaaagccgatagaccacgatgtaccttatcaacgaccgcctttgcacccacgttgccgcagtattttacagcttgtaaccaagagctggaaagagcttgggattgatggtgtagatgaaatgccatcaagcacgagagcaagccaagatggccctgtatcagagcagattaactacgaaaattggttgaaaagcaaatcgcctgagcaacaagatcaggtattgggcaaaggtaaggcggatttatggcgtagaggcgtgattacttttgcggatatgttggatcagagtgggagaccgttgactttggcaaatttaaatgcaaaatttaatactcaagatggagtaataaaacaaatgcgttcaaattggtcagacgattttcccgatacagttatagatagaaaattaggtgatgcaacatctcaccctctttatgaattagccaagagaggggatattgatgcggcttaccatttggcaaaagatcttgtttcagatgaagcaattgagaaattgcgtaaaatcatcgctggtcggaatgttattattgttccagttcacgctgaagaagctgttggtagaaatatgattcctgtagcaactgctacagtgctagcgaagaaattgaatgtaaaagtcgatctttccattgttcaagcaactaaggtttctagaacagcaggtgatggttggcatagattgatttattcccctgcatttgatggagaatatcctaaaggtcaactggctattattctcgatgatactcaaacgcaaggcggtacattagccagccttaaagggtatattgagcaacaaaatggcaaagttgttggtgcttatgctttgacaggaaaacaatattctgtacaattacgactatctaaagaaacactgaatcaattgagggaaaagtatggcagtattgaatattggtggacggcagaatttggctatgacttctcaaaactcacagaatgggaagcgagatttatcctcaattcacgtaagacagctgacgaagtcagaaatacaatcattgcgagaaagcaagcgtgaagcctatgaaagaatgatgaaattagattaagcactaggtattaatgcttatttctaaaccaaacaatttttctactaacctagcctaagtgctaggtttttttatacctaaatttcaactaaaccgcttatacagcaatgtgtaagcggttttttattgcctgtaagatagaaaagtacactcgacaagtagcgtttgtgtctcccactcgctatttcttacaggtttctttttagtgggaagaaactaggaggcatttatgcaagcattaaaagcaaaattctttggttcagaaattttagtcatcaatcataacagcaagccttatgtgccgatgaaacagattgtagaaaatatcggtttagtctggcacgcacaattcgagcgattacagcgcaatgaggttctttcgcaaggtattcgtgttatacgaataccttcaaatggtggtgaacaagaagcggtttgtttaccattgcactatctcaatgggtggctatttggggtcaaagtttccaaagttaagccagaattaaaagagaaacttattcgttatcaaaaagaatgttatgaagtgctttgggattactggactacgggcgtagcgaagtgggatgaaattcgacaacggcgagaagttctagaagaaaatgaaaacgcatcaaaaaaacgcgcaagcgaagcaggacgagcattacaaaaacgaaaattagaaaagcatacttatgaaattggtatagcacggctagatagaatggaacagttattacttgatatttaaggtgtgattataacgattgcaccttttttattacctgaaacctaaccgcactttcgcaagatcgtgcggtttttattatccacgtttcggaagaaacacaaacttacttaggaaggaaatccaaatgaaattaaaacttgatgaaaaaggcaatgttgtggttgtagatggtaaacctgtgtatacccacgatgacgggaaggaaatcccttttgatgcaccgcaagcaatgcaaaaaatttcttcgctcaatgctgaaaacaaacaacaccgtgaggctaaagaaaaagcggaagcagaactcaaaaagtttgacggaattgatgatgtggcaaaagcaaaagaggccttaaaaacggtggaaaatcttgatgctaaaaaactgattgatgcaggtgaagcggaaaaggttaaacaagaagtgattaagggctatgagcaaaaactggcagatgccaaagcgttagcagagaaagtacaagggcagttacatactgagttaattggaggttcgtttgctcgctctaagtttgtcacagagaaattggcaatgcctgttgatgtggctcaagcgttctttggtaagcattttagcattgatgaaaacggtgcaattttggcaaaagatgcgcttggcaacgaaattttcagtcgagtgaaaccagggcaacgtgcggattttgaagaggcgttagaggctttagtggatgcttaccctaacaaagattctattctaaaaggctctggctcaagcggtggtggcggtggtgctggctctcccgctggcaaacaatttaaacgtagccaaatgacccctgaagagatgaacaagtttattcaggaacacggtcgtgaggcatatcttaatctacctaaagaataaaggaaaacattatggcaacaggcttaaacaaagatgtgattatctacaatgaactggctcaaactgcatatttagagcgtattcaagataatcttaatgtatttaatgctgcttcaaacggctgcattttattgcaagatgagaatatccaaggcgattttcgcaaacaatctttttacaaaatcggtggttctttggaacatcgtgatgtaaatagtaatggcgcggttgagaataaaaccattgcgatgggtgaaatggttggcgtgaaaattccgtttaaatacggcccttatgcaattacggaagaggcaatgaaacgccgagcgagaagcacggaggagttttctatccttattggccaagactatgcggatgcattattagacggttattttaaatacttgactgctggtgcaatggcggcaattgggacgaatggtgatatgaaagcctcggcgtctattgcaaccgatcacaaaaaagtattgaccaaagggatgcgtaagtttggggataaatttgggcgaattggtttatgggtgatggactctgctgtctattttgatctgattgatgatgcaattacaaataaagtatttgaatcggaagaccagattatttatggcggtttaccggcaacaatgggcaagcctgtgttagtaacggataaagccaaagctaacaccattttaggcttacaagccggagcaattactatcacgaattcgcaattaccgggtttccgagcttatgacattaacagtgaagaaaacttagcgattggtattcgtgcggaaggcacatttaaccttgatgttttaggttattcgtacaaagaaagtgcgggagcgaaccctaacctttcgaccattggcacggaagcaagttggcaaaaatatgcgaccagcaataaaaatacggctggcgtgttaattgaattaagctaactaagttaagtgaatataaaagcggtgcgtttttgcaaaaaattaacaaaatcgtaccgctttttatgttgagaaggagtaatcaatgcaattaatttatacaacgcaaaccacaggatttgaaccgcataaacattaccgaaatccgctgtattttgaaaaagcagaaagtaaggtgaccgatgtggtgatttatggggattttcctaagattgcacaagcgtatcaatccttaggggttaaggttcaatgggttgatgaacaatctgataaaaaaccattagacaagatgaccgtgccagaattaaccaccgcacttaaagccttaaatgtggaaattccgcaagataccataagacacaacaaattttatttcataaatgtgtctaaattaaatgctgtctgtttttgcaaaacagcctgtgcaatagtgactaatttacgcattaaagccgtgataatcaccattttaggtttgccgcattcaagcaatcgcagcacaaacgagcgatatacgctgtttttgtagctgccaaaggcaaagttcattgcagggcaaaagagtgccttacgaatgtcggattgcccgatttttgaaataccaataacggtatttaaacttttccccgaacttttaatcatcggggttaaacctgcaaaagtggcggctgctttcgcgtttttaaaacgatttccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacattgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttccatcacgcagtgaaaagtttcaccaaatgtattgagccattgcataagtgattgaaatccttctggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcgaagcaactctactttctctataaccccattatgaaggtactcgtaatggggtttccttttgcccatattctaatacaagggggtaatatgttagtttcacttatcgattttttaggttggctgatattgattagtgttatatatgtattcattgcagaaatatttgaattttttaaagtgctaatcaaagctgtctatgatcttttttaaaacctaaagcggtcacatttgaccgcttttttgcaaatagctaaccatcagccaacgccttaatcacaaaattttcaatcatttcaatatcttcatcggtaaagcctaacaactcacgctgatcgtatttcaccttccaatttgcacttctcaccactcgaccttttaacccgtactggtgaatttgtgcaatatgtgcgtcactgccactgtaacccaactcgatattatccccagcggttcttaacttcataaatcgggctgacttcaattttaagaacattgcattttgtttaatctttcccttgcgtttcttacgttgtactttgcgtggcgtgtacgacgagccgtcaggattttgctgtgcggtaatacgtctgcgttggctacgagccaattcacgcccgatttgttgatatagcaaccgtcgccgtggtttgctgatatttttgagcaacgcattaaacgctgatttaactttgataatgtcgtctgtcgccattattccatcgctcccattcgctcatacacctgttcccctttcacaaaatagtcagccgttccagaggttgccattcggtcggctgtggctcttcggcgtggtgaacttggtaatgatcgccttcttgtttgacaataacacgctcggtcagtgggattttgatgtaaatatcgtgggtggcgttgttgtttgggtcaatttcaaaggtgatactgtcctgtttgttgggattggtcatcagctccgattgttgcaagcggataaattccatcacaggcacaaacagtaaatcagggtgttcagggaaatcttccaccacaatttctaagtcgtagagatattggtagctaagtgatgtcgcccctgtcgcccagattttgccgttggcatagtaaatctgtaattgctcaggttttttcgcaaaataaggaatggttttggtgagcaggtcacgcaatttgtctggtttaatcatttgcgatagcctttttgtttgtattcataaatttgttggcaatcaatgcaacgggtgcaaccttgcacgttttggcgacgggcttcgggaattggttcgtcgcaatcttcgcaatgggtcaggctacaagcggtcggtttgttgcgaagttttgcaagggcaaactctctttctttttcggcaagctcattggctcggtcaatttggtctttcatcgctttttctcgttgagttaaatagcgatattgtgagtaagtagcaaaggtggggcgaatggttgtgggtgtggatttgggggtaacaaaaaagcgactagtgtcgctttatttaactgacaatatttcgataatagaaaaattgttctgcaatgtgtcggaaatgtttcattattacacgatgattttcttctcgttgagctgcaattttatgggctaatggttcaggtaaaatggtaataagtaaataatctgagccatcttcaacatacacaagacaagtatcactcgttcggcgttgccctgtttgccaatgtttatcccaatttattttatcaaggatattaataacgggaacaagatgaacgtgtcttaatcctgattgaataggggtataaaacccatctttgccaaaatgatagctactattttcgccattttgtttccaatatttaaactgttcaataaagaattgtttatcttcttcatcggaaaatgccatattgaagagttgcgtatatgcaacattcatttaatcagcaccattgctcgcattagactttcttctgtcatttgctgtgcataacgttcaacattcgcaaacactttatattcttgtgggctgagtgctggcacttcacgcaatggcttttggtgtgtttcaaccactgcaaatactgcattatgcggcacttgcgccataggttgagcttgtaaaataatcattgtttttctccgctttgtaaagggaatagttggatcctaacgttgaataagaaaattgtcaatttacgaccaaaagccttgattggtcgggactttgcgttctaacattttgatttgattgttttaattgctgttgtagtaccaacagagcatttttttgaatttcttctttggttttaccgacaattcgtgtgccaccgacttgttttgtgcgatcaacaatttcacgaatataaggtgcatttttattcatattgcccctccattacatagaaaacgtacaatatattttgcattgtcggctttttattttcatctgtcaataaaaagccccgactagtcggggcaatcattattctgtaatacgtttattataaccttccacacacgcttcccagccttgaatttcaacctgacaaagctcaatggtcgttaaactttggtcgagagattttgcaagatcagcgttggtttttatctcgaacttggggctgtggcactgctttatttgggggcaaaggagcggaattggctttactgttcgatactgtatcgcttctttggttgagcaaccgactaacgccagtaggcacaggctgataactccaagattgattgttttccagttcaagtaagatttcattggtgcgtttctccgcttgggtgagcttagttaaaatttgttgatgtaatttatccacctgcttttgatactgcagaatatgttggtttgcctgttctagccggttggctaggctttggttatccgctcgcactaaagcaatttcttcttgtttggattggttgtccgcctgcagtgttttgcgttcataacagagaaaggcattaatgcagacaccaatcagcaaggcgataatcatcgctttgccaaaacttttctcaatcataccgcttataatgctaaacatagtgctttttccttttctcgtctgatttctaaaccacgcagttttttgccattggcatagacccaacggctaaactgttcacacattgcagggctgtaaccttgattggcgagtttgaacaaggtcgaatgtcgcattgttccgcaacctgcattgaaggtaattgatgtcaatgcgtcaaacgctccttgtggcatttttttgccgttggcgtagcggtttacgcaccgttccgcttcggctaaatcttttgcccagcggtcagcaatttctttgtcgctgtaaattttgcgttcaatcttaccgcttgtggcttcggttgaaccaatgccgacggtgagtacattcgcagggcaaacataaggatctcgtctgcacccttcagtgttgccgataatgtctaagccttttggactggtgcggatttcagggtgattaagctgtactaagccgataattgcaccgataccgcagaccatcgctccgccgaatttaagatttttgttcatcgtctaaaatgtcctttaagttgattttataacgctcaagggctttttctttcagtttgatttctcggtctttgtagtaccaattcatcaatagggtaaacaagccgaataaaatccccattattacgccccgtcggctgcgtggtttgctcggtttagtcggtgtcggcttggtttaactgcttctgaagttttttaacactgccttgcacaccgatgtttaaattcagttctaatgcccgttctaagtagctgagtgccgtttcaggctgtgtcgtttcaagtagcaagccgatttcacggtagagccttgctcgactttcgtctggcatatctttctctttggtgagttcgtccactcgtaacaagtagctcacttcaaacggcttttgcaccttctgggcttttttcgctgcgtcagcaaactcttcagcaagcattgagcaaagcgaacgactaaagccgtcaggcaatgtcaggtcttgatgaatggcgtaatcggcaatttgtaaagcaaggtgatactcgccacaatccaccgaccatacttgccacgtcatcagtacattgtcctgtttgccgttgcccgcactcaatgccccttcaatccacggcaaatagtggtgaagaatgctttttttataactggctcgctgttccattgaggcaatggctttcaggtcttttttatgacgagccagcaaataaagcattttttcgtattcgtcgaggttttctagttgagcttgctcagaagattgagcaagctccgcagttactcgcaaatagtgggcttgagttggtcgcattaaccgcctactccagtagtatcaggtgaaccaagcatactaatgtttttcaacagggcgacttgtgcataattttcgacaacgaaatcatcgttagaagaaacgaaatttttacccgtaaaaatgtggttgtaatccacaccgttgtcttgtgctacacctgcaaggtaagtgttaaatttggtcgctgtttcttttctcatattctgtcctttttagaaaacacgttcattatttaattcaccacccgtaatttcagggcgtggcgtgtagccgtgttctggctcactgccgataacatcaacacggctttgtaaagcggtgagatcggcggataatttttcaaaatctgcacgcaatgcgactttttccgcttcggcttgttttagcttctcttctagctctgtaaattttccgctaaaagcaactgtgcctgttcatgttcagcaaaacgtgcttcaacatcggctttatgttgggcggtgtcggctttttctttactaaacatcgctttcattttttcaaagaatgacactggctcttctgcaaaggtaagcgaacattccaccgcttcagtggtaaagatttcgccttgctgttcaccatttttcgttgtgaaagagagatattgggtgcctaagcttgctggcgtgtcagtcaccgctaaacctgtcaaataggctttgcctgttttggcaaaattggtgcggacttcgattgaggtgtaaaccttctgcttactcttcactaactcgactaattcatccgttggctcaatttgtgcataaagctgtaatttgccttcgtcattctcttctgccttaacggctaacacatcaccgtagcattttgaatgggcaagttcagggtcgaaccaaaacaagtgaaaatgttcaaggttgatacgagcgccgtaggttttcgggtcgtacgtttcggcaatatcagaaagccactggcgttcgatctgacgaccgtccaccgttgctccttctgtggctaccacaaaccagttggattttttcggcataaatgcttcctcgaaatgagaatgttcaaaattgccgatatggtgattggattttcaaacaggtgcaaagcgttgcggttgttaagcaggatttaacaaaggggactgttctacaaacgccgtccgtttcataacaatagccatattttcaacgatgacgcaaaacaatgacggatattgcaacaaaccaagcggaacagaccgctttaattaatatgaatacccaccgtgaagcacaattaaagtattgggctggctattcactcacggaaattgccaaaatgcttaacattcccgtgtccactatcgccagctggaagaaacgggaaaaatgggacgaagcacctttgtttgaacgtgtgagcggtaatattgagagccgttatatgttgctgttacaaaaggacgttaaaacagggtacgattttaaagagttggattttttaatgcaccgccgagagtagaaggcggtgattatcgtgtgttgcatacggatacttttcctgctcggcggtaatgtacctcttgcattttgcattgtgcgagcttgcacaaacatcaaggtcaaatgttctgtagaagatcagacttgatctgacaaatcattataaaaatgagagtttcccgtttagaatatgagtgtctaaaattcaatctaaacaaaaaaggaaactctcatgttttattacttacaatccgctcattaaacacaagactggtttactcaatttagcagaagagctcggaaacatttctcaagcttgtaaagcgatgggaatgagccgagatacattctatcgctatcaacaagccgtagagcaaggcggtgttgaagcattacttaatcaaactcgtcgggtaccgaatatcaaaaatcgagtagacgagcacattgagcaagctgttgtaaaatttgccttagattttccggcttacttatcagcaaacatttgttgatacttatagcaaggttgcttttgcaaagctctacacaataaaaaccgcaattgccgctgcagatatgctcaatgataaagtcctaccgttctttgaagcccaaggattaccgatgttgcgtattctcaccgaccgtggcagtgaatattgtggcaaagtggaaaatcacgattatgagctttatttagcgataaatgacatagagcatactaaaacgaaagtgaagcatccacagacgaatggtatctgtgaacgtttccataagactatcttacaagaattttaccaagtcgcatttaggaagaaaatatatacggatttagcgacattacaagctgatttagatgagtggttaatgtattataatcaccatcgaacacatcaaggaaaaatgtgctgtggcagaactccgatggcaacattacttgatggaaaagggatttgggcagaaaagaatttaagctcaaattaatctgacagacacggtaattttaagcggggctgtcagattaggtttgatcttctacagctaaagaaggcaataacggccatcattgcataaccaaatgtacgaccctatcccaaattctgtgtaaacacccatttcaacttaatggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaaactacgatacaatctaggtaaacaattggataaaccgcatcaagtgggcgattttgccatgccattacgcgttctttcacggcgtcggtaacgcgagaaatcaggctgcttgacacatccgcatcatagagttctttgaacatttcaacgatttcctgattacttaaccctttggaatataaggcaataatctgctcatccattcctgtgatgcgggtttgatttttcttgataagttgcggttcaaaggtgccgtcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctcaaatgtacccattttgaactcctgtttttagattgaaagaaattctaacataaaaataacaagctgtttttgtttttctactttattacacaaaacatcaatcagcattattttgatcgtctgcaaatttcttcattaattggctcatttgctggcaatgtttttcaaatttacgacaatgtgggcaatacaataaatggattcttacccctattttttctttaagcaataacggtctttcttgagcttcagagaccaatttcgtcacttcttgacatttcattttttgcccccaaaaatagatttactggataaacattgttgcaattgtaagcgtgaacgatacaacaaagtatgtagattggcttgactaatttctgctgtatggcaaatttcattagcagagagttctaaatactctcgcatcataaacacgtgcgcttgttttgctggaagtttagtgagacacagttcaaaaataatccaaaattcatcggaataaacggcattttcgggctgttgccattcttgtggataacactcctctcgccaatacccatcttgatcaaaaaatacattgctatcgttttcatcatctcgcaaatcactttcaagaactaaacgatctttttgacgcagatagtcaataattttatttttcaaaatagcaaatacccaagttttaaatgcggcatcacgtttaaaactatctaaatttttaagtgcgttgagcaatgcttcttgcaccatatcttctgctaactgactgtctcgtagctgaagatgagcaaattttagcatttgttctctaattgctgccatttgagatgaattaatttcttttaaaatcatagtgttatatatttttctaaaaaaatgaaaaatttttgtaaggatttccctcttacaccgactaataaggtgaaagggaaacttttcgtaaaaactaacctatcttaaccttaacaaatctttttacaagaggaaaaatttatgaaaactttacttaaagtattaatgacaacttctttagtttctattgctacaatcaatacagcaaatgcagaaatgatggatgattgcaaaaataaaatgagagcagattgccaaactatggaaaatatgaaacattctgaaatgaaaaaaaatcatatgatgaagtctgatgatatgaaaaaggatggaatgatgaagtctgatgatatgaaaaaggatggaatgatgaagtctgatgatatgaaaaaggatggaatgatgaaatctgatgatatgaaaaaggatggaatgatgaaatctgatgatatgaaaaaagatcatatgatgaaatctgacaaaatgaaaaaagaaaagatgtaatttaccatctaaaaataattctaataaatcgagcagtagtatatttacacactaatacctctactgcttatttcagaattagagaaaattcgaaggagaatatatgaaatctcataaaaccgtattatttacccttattatgtctgctatatctaataattctctagcaataaatcatactaataattcaagtaaggaaatgagtaaaatgacacaaactcaaaatgagaatattcgtgaaatttatttagctggtggctgtttctggggaattgaagcctatatggaacgtatttatggcgtaaaaaatgctacgtcaggctatgccaatggtaaaaccgataaaacgcattatcatattatcggaaaaaccgatcatgcagaaaccgtgcatataacttacgatgctaataaaatttcattagaaaaattacttaaatattattttcaggtcatagacccgactagcctgaataaacagggaaatgatcgtggtagacaataccgcacgggaatttattatcaaaatgagcaagataaagctattattctaaaagaaattgaagcgctacaaacgaaatataaagacaaaattcaagtggaagttgaaccacttaaacattacatcttagcagaagagtatcaccaagattacttaaagaaaaatccaaacggttattgtcacattgatttagaacaagcaaataatattattattgatcctaaagattatccaaagccaagtgatgaagaattaaaagctaaattaacacctttacaatacagtgtgacacagaaaaagaataccgaacgttcatttagtaatgaatattgggataacaaaaaagatggactttatgtggatattaccacaggggagccgctattttcttctagagataaatatgattcgggctgcggttggccaagtttcacaaaaccaattgacaaaaatgtggtgacttatcaaaaagataccagttttaatatgattagaacggaagtcttaagtcgcagcggtaaagctcatttaggtcacgtatttgatgacggtcctaaagataaaggtggattgcgttattgcatcaacagcgctgctgttaaatttattcctcttgagcaaatggaaaaagaaaattatggatatttaattaacttaatcaaaggaaaataaaatgttcgaccagaatttactcatcaggagcctctcccacaatttgtgtaaatacctgtttctgagataatacattcagacacaggtattttattatgaacgaaaaacaacttcacgccttggcagcggaatttgccaaaaatctaaaaacaccggaagacctcaatcaattttcacggatgctcaagaaaatcaccgtcgaggctgcgttaaatggtgaactgaccgaccatcttggttatgaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcctggaagccatcaatgcagtctatcctaaaacgaagattcagctttgcattgtgcatttagtgcgtaacagcttgaaattcgtttcgtggaaagattacaaagccgtcaccgcagatttaaagcaggtttatcaggccccgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatagggtcctcatcagcagtgtatttttagctggattagcctcttttttatctccttgcattttcccaattgtgcccatctattttggcatattaagtaaaggtggtaaaaaggtattaaatacactcctatttattatgggattatcactcacatttgttagccttggttttagttttggctttttaggtgatttattattaaatgatactacgcgtgttattgctggaattattgttattattcttggtattcatcaacttggtatcataaaaatcaatttcttagaacaaactaaattagttgaaattaaaacaaatggtaaaagcgcttctgtagaagcttttgtattgggtttaacttttagtcttggctggacgccttgtatcggaccaattttagcttcagtgctagcattatcaggcgatgaaggttctgctctatacggtggtgcaatgatgtttgtttatgtattaggtttagccctaccttttattatcttttcattcttttctgatgaattattaaaaagagctaaatcacttaacaagcacttagataaatttaaaatcattggtggaacactaattattttaatgggattattgttaatcactaataacttacatagttttatgtaatataggagaaatataagatgaaaaaaataatgggcttacttctcatgctatttagctttaatgcttttgctgaagaaaataaaaatttggcagacattcaatttaaagatctcgataacaatatcgtttctttagaaaagtataaaggaaaaaatgtctatgtaaaaatgtgggcatcttggtgtccgatttgtttggctggcttggctgaaattgatgatttaagcgctgatcaaaataaaaattttgaagttattactattgtttctccagataaaaaaggggaaaaatcaactgaaaaatttattgaatggtataaaggactggactataaaaatgtcgttgtactattagatgaacaaggtgaagtgctgaaaagagccaaagtcagaggttacccttccaatgtttttttagattctgaattaaacgttaaaaaagttgtaccagggcatttatcaacgacacaaattactgaaagtattaactcaaaataaaaaataaaacctaatctaacgatcaaatataaaatgaaccgttaggttaggtttatttttttataagctaagttgtagaagatcagacttgatctgacaaatcattataaaaatgagagtttcccgtttagaccctatcccaaattctgtgtaaacacccatttcaacttaacggtgatcgtctaagcgatcaccaaaatcaatcataaatcgattcatcgccagtttccggttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccagataatcaaaaaatgtggcaatatttgcccagttatcttcccagcctttcgccacaagcgggtattttgcctgccattatagagcttttagtcgttatctaggacagccccaagatattttacacacattatgctatctctctactaagagtataaataatgctaaagcgataatttagtaaattgattttttctaataaaaagtacctataatttgagatattactttttctcttttgatgaagagtcagtagtactgttttgagatagcatgttttttgtaaaagaaagtttactatttagaaatatttttctattccgtgtgatttttctagctaaattctgtattttaattaaaatatgcgtgttcatttttattgacaggtaattgtatgaaaaacaaaacattaggaagtaccttaattgttgcaggtacgacaatcggggctggaatgcttgctatgcctttgacatcggcaggtatcggctttggttttacatttttacttttggttgcactttggttgttactttgctttagtgccttattattcgttgaagtgtatcaaactgtggacagtgacgcagggcttggtactttggcagaaaaatattatggccctttcgggcgtatagtttcaacaaccgttttaattgtatttctttacgctattttatccgcttatgtatcaggcggtagttcacttcttgctgcatttttaccaactattattgatgctgaaaccactacacgtatttcaggtgtaatttttaccgtggtatttgggatatttattattttaggtacgaccagtgttgatgcggtaaatcgtttattatttaccacgaaaatcctcgcttttatcttggtgttattcttactgttgccaaaagtgtctattgataacttaatggcaatgcctattgataatgcactgttaatttcagcaagtccaattttctttaccgcatttggtttccacggttcaattccaagtttgaacaaatatttagaaggcaatgtgaaagcgttgcgtatttctattgttgtgggtacatccattccgttagttgcctacattttatggcaattggcaacgcacggcgtattaactcaaacagaatttttacaaattttagaaaaagatccgacattaaacggtttggctgaagcggctagacaaattacaggtagttcaattattggtgcaatggtgcgaattttctcggtattagctttgatcacttcattcttaggtgtggcacttggtctatttgaagcattagaagatcttttaaaacgtgtaaatataaatgcaggaagagtgagtttaggtgcattaacctttattccgccaatgttatttgccttcttctatccacaaggctttattgcagctctaggctatgctgggcaaatgtttgctttctatgcgattgtgttaccaattgcaatggtttggaaattacgtcgtcaaaatctaaatttaccatatcaagtaaaaggtggttctatttccctattactcgctttagttattggggtatttatcgtgatggtaccatttttgattgaaagtggatggctaccaaaagtggttggataatttgttgaatagcaagtacaaaaattaagtcattttgtattatgaaaaaatacactgagtgtaattatttttttacattgagaatttttcgttacgttttgattttgttttgctagaatgcctaggatttttatttcaggagtttttatgaaaaataaaattttaggcagtgccttaatgattgcaggcacaaccattggtgcaggaatgttagcaatgccattaacttccgcaggaatgggctttggaatgacgttggtattgttagtgggattatggttgcttctcacctacactggattactgtttatggaagtctatcagaccgccgcacagcaagatgttggggtagcaacccttgctgaacagtattttggaatgcctggtcgcgtattagcgacagtgtgcttacttgtactgctttatgcacttttagctgcctacattacaggcggtggctctcttgtttcaggactattacctgaaatgggagaaggtgataccaccttaaaagttggcattttgcttttcacctttattttaggggtatttgttgtcgtaggtattaaaggggtagacggtttaactcgtgttctttttatcggtaaaatcgttgcatttgtatttgtactgttaatgatgtttccaaaagcaaaattggagaacttaaccgcagtgccactagataacttattagttatttcagtgatcccgattttcttcacctcttacggcttccacgttattatgggtagtattaatagctaccttgatgcggatattcgtaaaattagaattgcggtgattatcggtacagtgatccctctcggtgcttatttactatggcagttagcaacacacggcgtattaagccaaggcgaatttgtctctctattaaaccaagatccaaccttaaatggtttagttaaagcaaccagccaaatcacaggtagtaccctcttaggcgaaatggtgcgtattttctcagcgttggctttaatcacctccttcttaggggtagcaatgggtatttttgaagggggtggcgatttactaaaacgtgtaaacttgccagcaaatcgagcgattttgacacctttaacctttatccctccgcttgcatttgccttattctatccaaacggctttattgcagccttaggttatgcaggtttactctttgctttctacggattaattttacctatcggtttagcgtggaaagttcgccaagcacaccctaacttaccttaccgtgtagcaggtggttctatcggtttaattttggctttcattatgggtattgtgattattgttatcccattcctaatgcaaaacggtattttacctactgttgctggttagaggtatattgcttaggtttctattctgcaccttagttaattggtaaagccaaatctctttggggtgcagatccatatcaggttcctttaattttgtctctatgcctttattggaatattcttagggtaaaaagacagcttcttatcgttttttatctaatttttctggttgctcaattaaaattagaatggcggagttaccgccccattctcttggtgcttgatgtaacgcaatcactttcgggtgttggacaagccaacgagggatttgatatttcaatgcccttgtgccatagcctgtcataatgctggcacaataaatcccttctcgctcacaagctaaaattaaactcgccagctcttttttggcattttctttggtcaaaccgtgtaaatctaaaaagagttcagggtgaaagtcaccacgacgaagctgttttaaaatataaggatcaacatcttcccgacggtatttcactttatcattttcttcggttaataacggctcatattcatcggaaaaataaaacaatgtatccgctttttcttttaattctctgatctcattgatttttttacgcggttcaactttaggaacaaaggtatcttgtttgattttctttgttcccttaatcgcttctcgaaacaaagctaactcatcattttctaacataatatttccttttaaattaatcagcccattctaacacaaagggaaatatggtataaaacggcaatttttcaaaataggtattaaatatgtacgaacataaccttgaacttcttgatgaaatcgcttcatcgcctgttgctgacgatcttgccactattttagatatgatgcgttgggcatacagctactttaacgcctctgatctctattacggacacggacacgacaatgcgtgggatgaagccaatcaactggttttaaccgctcttgcattgccaatggacgtgccagaaacactctacgcttcacgcttaacctgtgtagaaaaagaacgtattattgaaatggtcgagcaacgtttaggcttacgcaaacccgttgcttacttaacaaattcggcgtggttctctggcttagagttttacgttgatgaacgagtgatagtgccacgttcccctatcggcgaattaattcaacaaggttttacggggattttacgagctgaaccaaaacgcattttagatatgtgtacaggaagtggctgtattgcgattgcttgtgccgacaaattcccaaatgctgaaattgatgcggttgatctctctgtagatgcgttaaatgtggctgaaatcaacattgaacgacacaatatggctcatcgggtattcccattccaatcagatctgttcaacgatctaccacaagatcgctatgatttaatcgtgactaatccgccttatgtcgatcaagaagacttagacgatatgccagaagaatttcaccacgagcccgaaatggcattaggttctggggcggacggcttggatattaccaaacgcattttagctcaagcggcagatttcttatccgataacggcgtattagtctgtgaagtgggtaacagtatggttcatttaattgaacaattcccaagcgtgccattccactggcttgaatttaaaaatggcggattaggggtgtttagtttgacccgtgagcagttagtggcgaatagacatttattcttttaactcatcgggttgttatatttcctgtattttagtacgtatataaagattaaattcagtaattttttagaaaattttcgttataatagaacccaatttttattaggaggaatatccatggctaccatcaaagatgttgctaaattggctggggtttcaaccactaccgtttctcacgttatcaataaaactcgctttgtggcagaagatactacaaaagccgtatgggatgcgattgccagcctaaattactcgcctagtgccgttgctcgaagcttaaaagtgaatacaacaaaatcaattggtatgattatcacaacaagcgaagccccgtactttgcggaaattgtgcttgccgttgaagaatactgctatcgtcaaggctattcgctatttttatgtaatacccaaaatgatgctgaaaaagtacaaaaccatttagatatgttaattaaaaaacgggttgatggcattttggtaatgtgttccgaatatacggaaaattccttggcgttatttaatggcacgaatgtacctatggtggttatggattggggtccgaatgatggtaagagtgaccgtattatagatcacagccttgatggtggttatatggcaaccaaacatttaattgataatggacattgtgatattgcgattattgcgggttatctttataaaacaaccgcaaaagcccgttatgatggttttgttaaggcaatgacggaagcaggtctgttgatccgcaaagagtggatttttgaaaatgactttcagcctgagggcggttatgaaagtatgaataatttgctcaaacaggataagttacccaccgctgtgatctgtggttgtgatgcaatggcgttaggtgtgatttcagccattacagaaaaagggctttctgttccgcaggatatttccgtgattggctatgataatatccatagttcacgtttctatgcaccgcctttgacaactattcatcaatctaaaacacgtttagggcaaatggcaattgataccttattagagcgtattcaacagcataatgagcaaccgtctgagcctgttactcctaaagtattggaattttatccagaattagtggtgcgtagttcggttcgcaacctaaatcaataaggacgttagaatggaactattaattgagtttttcagtagctatggttattgggcagtatttctagtcttactcgcctgtggctttggtttgcctattcctgaagatatcacattagtgtctggtggggtgatttctggtttaggatacaccaatgttcattggatgttgtttgtcagtatgctgggcgtattagtgggcgacagtaccatgtactggttgggtcgtatttacggcgagaagattttgcaatttcctcttattcgccgtattgcaaccccagaacgcttcgcaacggtacaggaacgctttgaaaaacagggctggaaattgctttttgtagcacgttttttacctggtcttcgtgctgtggtgtatctggtttcgggtatcacacgccgagtaacctttactcgctttgtgttagtggatttctttgcagcaattatttccgtacccatttggatctatttaggggattttggtgcaaagaacctagactggctacatcaacaaattcaaaaaggacagatggcaatttggcttatgttattgattggcgtagccattgtattttggaaatggaaaaagtctcataaagtaaattgaaaaacataaaaaaagcccctataacaggggctactcggaaagcaaatttgtgatttgggttattggacataacacttatttttgttgctgtaagattacatcaattttttgagtttttcaaattttaggcatagtagacaaaagtgttggtaaaaagtgggctaaagccttatagcacaaggctttaagcccactttttgaaatataaacaaaaaactgtcctttttgccttaagaacaatatccaaaagtatcactgttccattagaactattcaacgttatattgaaaaatcccccaaagctaaattaattcctttacaacaaacctatctcaatattatttcagacgtgaccttttttggtcgtgaatttggtgtattagttttaatagataccttatctaaatcaccgctttcattagatttccgcctattatttctaacttttattgataaaagttgaaaaattcttgttattttattcttagttttgtgtaactcttggtttttttttttttttacaatggagtgggggcaggtgtttttgagattcccccacttgtgggggaagtagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatggggggcatttgtgcatcctgaaaatgtaaataaaggtttatgattttttattaggaaaaacaatagagaaggttattatgaataaaatatttagagttatttggagtcatactcaacaggcttgggtagttgtatctgagttagtaaagtctcataccaaaacatccgcttacacggataaaagagctcaagtatgcacctcagattattttttagataaacagcaagataaatttaaattaagtcttttaagtctagtattactaagtatattttttagtccagtagcagtaggtgtagatcgtcataaaggaaatccatatcttgtagatagtgctggtaaatcggatttaggaactgacgacggtactattggtattggtaaaagtagtaaggctgggtatggtgctattgctatcggtcagtattcaaaagctgaagctaggcataatgttgcgataggttatgatgcaaattcaggagtacaaccaaacactattacgataggctacaatactcaagtaactggggaggaaggaattgccatcgggaaacagtcaaaagcgggagggaaatctgttgtcttaggcggacaagccaaggggacaagtactcaaacagttgcaataggtaacttggctactgcaagtgcgtcacaatctattgctatcggtgcgagaagtaagtctaccgctgagtacggtattgcggttggtggtagtgcaagtgctgatggaaagaacgccgttgctgttggtagggaatcgaaaggtactggggcaaattccattgcgataggtaagtctgcgagaacagcaggggtagactctgttgttgtgggtgcccatatcaatgtgacaggtgaaaaatcagtggcaattggacgccaagcaaattctggaagtcattctactgccttgggttatcaagcctctgccggtggtatgcactctgttgctgtgggtgaaaatgccgtgacaaataatggtgttgctagagcaaccgcacttggtaataataccgttgtcaccgtgggtggcggtgtggcattgggttatggttctaatgcaagtacagctggcggtgtagaggggttaaaacaagattattctgccacaacgggaggaagcactgaagctaacggctttaaatccacagaacgtgttgatggtaataagattggtgcggtttctgtcggtttagcaggtaataaactcatcaaacgccaaatcgtcaatgtggcggctggtacacaagataccgatgcggtaaacgtggcacagcttaaatcgctcaccatgaaaattgatggtgatagtaaaacagacacacctaaggttggcttgtggagtggtacgctcaaggtaaaaggcgacaacggtcttacttcccatgctaatggcgatacgattacggttaaattagagcaagatgtcaaaaataaaattgataagattgacaatttaggttggaaacttgcaattactcagggatcggggggtcaagctactcctttgaatagtccacatcttatcaaaatggaccagaccgtaacctttaccgctggaaataatattaaattagaacaaacgggcggaaatattacgatttctacgattattggtaagttaattacaaagactgaaagcctagcagatggtggtttgaaaattacttatacggatggtatgcatgacattatcaagaaaggtgaaaaaggagatcgtggcgaaaaaggtccaaaaggcgatagaggagaaactggctctgcgggtccagcgggtccagcaggtgctcaaggtccagtaggtcctgcgggtccagcaggtccaactggaccacaaggtccaactggaccacaaggtgcaactggtcctgcaggtccaaaaggagaggcaggagcagctggacctaagggtgagaaaggtgatccaggaccaaaaggcgaagctggttcaacaggtccaacggggcctgctggtccaaaaggcgatccaggacaagcgggtccaaaaggagatacaggtcagaaaggtgaaactggccctgcgggtccagcgggtccaaaaggtgatacaggtcagaaaggtgaaactggctctgcgggtccagcgggaccaaagggtgaaccgggtcctaaaggtgaacaaggtattccaggccctgcgggtccagcgggacctaagggtgacaaaggtgatacgggtccagcaggaccacaaggccctgcgggtccaacgggaccacaagaccctgcgggtccaactggaaattcggaattaaaaggcattacctcgatagccaatggtaacgacgccaccaaggcgaatggggctaagattaccttgtctgcaggttctacagataaaacagttaatgttaatgatgcgaaaattaccaatgtggcggctggtacagcagatactgatgcggtaaatgtgagccagttaaatactaaggcagcagcttcaaaaacagaggttaaatcaacggacaaatcggttggcgttacagcaagtaaaggtgacaaagatcaaacgatttatgatttatcggtggtgaaatctaaattgaaggctgctgaggataaacgtacagttacggctgaaaccaagggcaatgcttttgtaacaggagatgaagtcgcagtagcaattaataccacaaccgcagcggcgagaactgaggttgaagcgggtaaaaatgtgaaagtgacttcaaaaacgggagcaaatggtcagaatattcacaatgtgagcgtgtctggagatttaagcgacattacttcaattagtaatggcgatacgaaagtatctttaggtaaagataagcaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaatttctgataatggcaaatggcttattcgagcgtctgttagcagtaatactcagcgggatactatgattggaggaggggtaggttttgtgtggtaatctagcacctataaattagaatttcatgctcaatgccgttgttattttaacaatggcattgtttggcatagtagacaaaagtgttggttttaattatttttcctaattatcaccaactctttttatttaaaaaatcctttaacagccctctacgcccatcatttgtaatggattgaatcctatagcctttttctcgaagtatgttcaatgcgagcttataatagaggtctttttctgttttgatgacacggtgataaacgactttttataggtttgttttcctattgtgtaatcaatccaaatatctattggatttaatttatttgtggaagaaaaggttttatgacaggacgaacaaaagtacctctgaatattatttttctttccatacttttggatattgttcttaaggcaaaaaggacagttttttgttcatatttcaaaaagtgagttaaagccttgtactataaggctttagcccactttttaccaacacttttgtctactatgctaaattttatttgcataaaaacataatttttttatttttatgataaaaatcaaattttatgttcctaatttagtagccaagctctgccataatgtttcatatgacctgctttttgtcctgcttgatgtccaattccttgataaaggtcgaaatgttgtcccttcactgcgcccccaacatctaatgctaccattaggcggaattcatggcgaccattccagttaccattgtgatcaaggataggcatctcaattaataatacacttcctgttggaatgaggcgcttatctgatgcaactgatgctaaaggaactaatgggactcttgctgagccttttacttctagtgttggatctcggcggaagtaaacaaaagaattatttctttccagtagtgactgcaatctgtgaggattttctttactccatttacgaattgcttgaatagagatattctctttcgctatttctccatcttctactaacaaacgaccgatactggtgtaagcatagccatttttatctccgtaggctaaatgatgtagcctaccaccaccgatatcaacaaagccactaccttgtacttccatcaaaaagttttccagcattgaattagtataagccaattctaaacctttgccagccagcgcaccgcggtaaatttgagctcttgagtattttttatttcctttaggaattgcataaagaggatgatgaaattcaccttctggacgtattcttgctgggattacagggatataatagcctgtcatcagtacattttggtacccatcctgccctcgcatttgttgaatttggactccgtaatgttttaaatctttaatttttcctccatgggataaccaagtaaagagcttattatatgtttttacatgatgcttcattaggttagttgaatggttttgaatatgagcaagttgttgtaaaaaatccttttgattaacaatgttattatttatctgaatatccgatatattcactaatggtacattagatggaataaatttacgttggtgaaatttagctcctaattttgttatttctgtattaggctgctcggatatttttgtagaacaagcagtaaataatgttagggtgctaagtaaaattatttttgaataagttttataaaacatatttgttcccttaaaaatatatatcaggtaaaattttttcttacctgatgttcataaaagtgtcataaaagacagaggagagtaatcatggaaatagttttgaatcttatttagattaaaacgtcacccacaaccgatcttgtttctacacgaacttctttaagtttcactttcaccgcttgcccgatttggtaagccttctcgcctttgatgtagagtgcaatctcttctgggctaaataacatttcttctttgttattatgcagagttgagaatggaacaaaaaccgaagctccattctcaatgactttaacacgcaagccaccacgagaaacatcttgaatttcgccgtcaaattctacgttttgttctaccattggcgcaagataacgggcatagagccagtcggcaatatcacgttcaaccatacgattttgcttacgagcttcctgtaagcgagttaaaacggtttcttcgacaggttttgctgtttgatttgcaaggacttgtttaattaaacgatgattgaccatatcgccgtatttacgaattggcgatgtccaagttgcataatgactgatgcctaagcctaaatgtggtgctgaggttgctttaaattcagcaaaagttaaatagcgacgtaaccgcatttctaagaaattttcagggaattgctcaatatcacgacgcatttcgcaatagccttcaagggtacttaaacgctctggggagtagcgttcggataaactttcacgattttcatcattggcaagggtatctagtaagaatttacgagctggctctagatttttgctatcaaaacctgagtgggtattaaatacgcctgtgtgtgcatatttatctaaaaactgtgcggcacagatgttggcaataatcattgcctcttcgatcatttggttagcgatacggcgatattcaatgtgaattgctttgactgcgccgtcttcagctaactcaaagctgtaatcgccttgctctttaaatagcaaggcatttttgctacgccagtcgatacgagcaagggtaaattgatgcaaccagtcgatttgttgtgcggtttctgcacagtctggtgtccagtgattttcgactttttcaagataatcagacacttcgtcatagaccaaacgagctttagattgaacccaagctgacacaaagcgagcttcacctaccacattaccgcttaaatctgtttcaatatagccgactaacgcagggcgtttttcattcggcacgagagagcaaagatcatcagacagctcccgtggcaacatcggaatgttaaaaccagggaggtagttggtgaaacagcgttggcgagccgctttttcaatcgcggattgctcaggaatgtaagcggtcggatcggcaatcgcaacgactaaacgccagcctgtttgcgtgccgttctcgctaattggttcaacgtataacgcatcgtccatatctttagtgctggcactgtcaatggtagtaaaatagaggtgagtgagatcttctcgatcgacttgatcctgtaattcatagcttttctcattcgcaacgggttcacgaggttgctcgtggcgagctaatgttacccaccacggagcgaaattatcgtccgctttgcagataaattgagtgacttgagcaaagaaaaagcgatcatcacgaagagggtgtgttttcaactgtgccaccacccagtcgccattttcaagggtttctgtcacttttttctgcgtattggctggaataaaattattgatacttgggtgatcaacggctaattgcaatttcccgtctttgttaaaacgcacttgagcgataaaacgttctaacattggctctaataacgagtcaatttcaacttgctctttatcgccatcacgcttcacaacagctttgaccttatcgccgtgcatcacttttttcatttccgcagggggaatgaaatagctatttttctcacattctaaaaagccataacttttatctgacgtttttacaacgccttcaacatattctttgcttgcttcaatctgttgttttaattgagctaatagggggttattttggaacatagattctcgtattgataaaaataaaaagcggtgcgaaatgcaccgatataactagaaaattatagcggatttcaggcagactgtctgagaaatttatgattttttcgatcgctatcgaaaaaatagcaaagcaagctagccaaaatatttttataccttaggctataaaatagctgaaaaattgtactgtgtacgttatactaaggttgtttgaatggaaacagaagaatatcttacttttattaaaaccaaagtttttgaagaagaccgaaaagcattaatgtctgatgatgaatatcagaaatttcaggcttatttattagaatctcacgaattaggcgattttattcagaatactggtggttgccaaaaaattcgctggaaactagaaagtaataacaagggcaaaagtggtggtgtaagggtgatttactatgttgtaaccaaacagggaaaattattattaatgatgatgtatgctaaaagcaaacaagacaatatgagtgataaacaaaaagcaatgttaaaagcggttgtatcccaattaagtgaggagtaaagatggaaaaagaactttttgaacgtctaatggaaagtgcgagagaaatggtcgccattgaaaaaggcgaaatagaagtaccaccgcatcgtattcatatccataaaatcccgaatgtcaaagcgattagaacccagcaccagatgaaacaagcggaatttgctccccttttaggcgtaagccaaaatcttgtgcagtcgtgggaaatcggcagacgaaccccaaatggcgctgcacggaaattgcttgcgattattgagcaacagccagaacttatccctgtattacaagggctttaggctttcattcaatgcaacagataaaactaccacaattttagtacgcggagattattatgcccaaacgcccatcaggaattgattctacactctttttattagagattttacgccgtatccccaaaaagccttatcgtttaactacgtctgaaatattcgatagtatgaaaaaggcaggctttgaaaaagataagcgaagtattcagcgtgcattaaaaaccttaagcgagcattttgacgatttggaatgtgatgatcgtgacaatgaatatgcgtattgttggcttgagagatcagtcggcatttccgtgccgatgttgaatgaacaacaagcgttaatcttaaaattagcggaacagcaacttaaatatctcttgcctgcgaatattatgtcgtcaatggaacccttttttaaacaggctgaaaaaattgtgggagcagggacgagtaatcctgaacatcaatggctcggaaaaatttgtagcgtaccgactagccagccacttatcccagccaaagtgaaagaggacgtttttacagttgtcagtaccgcacttttccaaaataagttactacatattgaataccaaaaccaagccggcaaaaaacataaagcacagattatgccgttggcaattgcacaacaaggggcaagcacctatttagtcgctcgttatgatgggtttgacgataaccgcttacttgccttacatcgtatcaaaaaagctgaattatcaacctttagctttgaacgcccaaaagactttaacttaaaacagtaccaagatgaagggaatttaggttttggtagtggtgggaaagtgaaactgacattttccattgctcgttgggccggcttccatttaaccgaaacgccactttcaaaagatcaaattacactcgaagaaagcgaagagcattaccgcttccaagcgactgttgctgatacggatatgttggaatggtggataagacgttttggcgaagagatttgggatattgagaaagagagtgtttagtgcgacatatcttgtcgtattgctgaatataatcagtttataacaagatttaatcatttgattgaagggtaaaatatgcatttatcagtaaattttaatcaagataaagataaaacattggacatcgctcaactagctacattttttaaaatgtggaaagagggtgtttttcttgagccttcggaagaaaaaaaggaattagtgattcctgatcgtgaaaaattacaatacttttttaatgagtataaagaagcacgagtaccgatggaagaagaaaaggctttaggcatgaaggttaatgtatggaaaaccgcaaacttggggcgttatgaggttcgcaatagtaaagttttacgctggtttttagatatgcatgaagatcacggacaaggaagtttcttcttaaaagcgttgtatgacagtctaggttgggataagtcatcctttcctttcccaagcgtttatcgggcaacggaagaatgttgtcctttaggagatgaaagtgaacgagtcgatattgaaattgaatctgacgaagtgttgctatttattgaggtaaaaattgatgctttagaaggtaaagagcagctaaaaagatatcatgatgttgccaaaataaaagcaggttcaagagaatggaaaattatttatttaacaaaagatggtattgttaaatatgatcaggaagataaacaaagtttatcggataaagaaaaaattataggtctttcttggacgcattttgcgaaagttttgcagaagcaaataagacaagagctaagaaaaaatccaaataaccgcagtttatggttagccgaacagtttgtagaacacatcttaactttttaatatgagggaaactaaaatgagtagacaagcagctttcaaattaatcattgaaaacattcagatgtttgatgaagcttcacatttaattaatgatgactttgattctgagctttttaatgctgtagataatgtgattaaagagttcgagtttgattttgagtgtaaaggaaaatttaattctgctgaaaatagattttcaacattttatccttcatactggttagcaaattcgtcagatgatacggatgcaaataattgctacgctcattattattttggttttgaatgtgatgaaacgggtaaaaaaattcattattgggggattacttctttattttcaaaagttgaaggaatggttttaggattctatagttggaaaaaacaattcccaaaatgcggcaataaagattggaaagagttcatgatagaacagaataaaaaatatcctgagctaggaaaattaggctttaaatttaatactaaaggctatgatttttatctaccaattaaatctttagatcctaagctagtcattgaaaactatcctgattccttagaagatgcaatggagccgattcgtgatgcgttaaaaacgttaaaagaagcccatccgatttttaacgaaattgttgaagcggcgaaaaagaaatttggcacaaactagggcttgttgatgttttgagattgcaaaatcatcaagaggtgtttatttaatatcccagcacgtcagagccgtactgggttacgcataattcagcccctttggggctgagaattagagtggcaaagccactcaactatacgtaacctagtacgcattttgcgtgctaggtataaaattataagcacaaaacattaacaagccttaaagtaattttcatgcgacatatcttgtcgtgttaaccattatatttaatagctccaatcaacaaggagatctatatgtctaaaaaagtgcaatttaccggcataggcttgcaaggtaatgagttcgtaaaaaatcacgaaaattcaccgcttgttacatcttttcattatattgagcaacttacagaagttatggcagtggatactgaagcattctcacttctgtttgtagaaaataatgagagagatttacagctgtgttatcagtttgcaaaatcattccaatttgattgcttatctgtagtcgtattaccaacaagaagagaaagtctgcatagtaattgtcataagtggctacttgatttagaaaagcgcatagatatccttattgcattaaataagccattaccagtagactgtatgttacttaaagagacggacttatttgatgctattacagtaataatagatttgatttcagagaataatttaattaatgttgatgtggaagatattaaaacagtttcttatggtgcaaaagaaatagacttttactcttttgaaatagagcgaaaaggagagacaattagtgctgatgatgtaattactcatttattatcaaaaagccacaagaaaataaaagaaataaatggtgcagttatctcaattacatcagatgaaaaccttcttttggatgaatatcatatgattatggaatccatatcgtcccttatttctgaggattgtacaatcatagcttctacaaatgagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgacggcacctttgaaccgcaacttatcaagaaaaaccaaacccgcatcacaggaatggatgagcagattattgccttatattccaaagggttaagtaatcaggaaatcgttgaaatgttcaaagaactctatgatgcggatgtgtcaagcagcctgatttctcgcgttaccgacgccgtgaaagaacgcgtaatggcatggcaaaatcgcccacttgatgcggtttatccaattgtttacctagattgtatcgtagtttcagctttgcattgtgcatttagtgcgtaacagcttgaaattcgtttcgtggaaagattacaaagccgtcaccgcagatttaaagcaggtttatcaggcctcgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatatggtcgtttttgtaaattttcacaaaaacttcttagttccttttgaattcttacgtttcatttccatattcatatcttaccggtccgactttgatttataccataaaacagtgcgatacatcttgtcgctatactcaataaaatactattgtgaaataggataggagatagttttatgagcaatcaatatcaattaaacccacctacggtttcagtttatgcagagcatttaatgttgaaactcttatttgagcataaaggctttcctgaaatttttagagagaatggctggcgagatgatgatattgcaactgcattaggcttaccgccagaaatggaaaatatcgacaatgtaagatcagttgtaaaagagcttttacaggctcgttataaagaaacaaatttttccgaagatgtgtctgaacgttggaaaatggcatatcaaaatattgaaaaattaagtgagattgtagagctaaatgaagcagaaaagaacatttttcgttttgttttccacttgagagcagaaaaacagatgaaagatttgatgtgctatcttccgcatatcaatttaagccaagctattgaaattgttgcggatattttatcgttgagtaaagatgatgtaagaaaggttttcagcaaaaaacagaaattatttgcttatggattaatggagttttctcatagccctgatcgattagaagagtatttggggtggggagatacattagactttgacgactttttaactcaacctttaacggaagagatgttattagctcgttgcactttaccaactgaaaagccgagcctttctctttcccattttgagcatataaaaacaacctatgaattaatgctttctcatttgaaatttagcattgataacgctaaaaaagggacgaacattttaattatggttcgccaggaacagggaaaaccgagcttgcagggttattgagcgaagcattgaatgtatcaagttatacgatggcatatatggatgaagatgatgatgtacttggtggaaaaagacggttagaaaattgccgtttagctcaacgtttattgcgagataaaagtacggtcattatttttgatgaaatcgaagatgtgtttgccagcagttttatggaacgctctgtggcacaggagaacaaggcgtgggttaatcagtttttggaaaataatgatgtaccgatgatctggctgtcaaattcggtcagttgtattgataacgcttatttacgccgttttgatcttgtgttcgaaatgcctgatttgccatttagtcataaagaaaagttaattcgttctattgtcaatgaacagttatctcacgattacattagccatttttcacaagtaaaagcattgtcgcctgcgataattacgcgtggattgacagtgatgaaacaggtgtattctgattgttctcaacaggattttgccgaaaaaacgttaaattggtttaatcaaatgttgaaatcgcaaggttttaagaaaatcgaaccgcttgtggaagggaaaattagctacaacttagattgggtcgcttgcaatgatgatattcataaaattactgaagggttgaagcggactaaacggggcagaatttgttgttatggtccaccgggaacgggcaaaacagcttgggcgaattggttagggcaagagttgggaatgtcagtattgatttgccaaggttcagatttgttggataaatatgtaggtggaacagagaaaaaattgctcaagcctttgcacaagccaaagaaaataatatggtgttggtctttgatgaagtagatactttcttgtttgcccgtgaaagtgggcaacgtagttgggaacatagccaagtcaatgaaatactgacccaaattgagaaatttgaagggctattggtggtctcaacgaatttaatggacgggcttgatcctgctgctttacgccgttttgatctcaaattgcattttgattatctcaagccagagcaagcggttaaatttgctcaagaacaagtcaataaattgagcttgcctgatttaactgatgttgaacaagatcgcattgctcaattaagaaatctgacccctggtgattttgccgcagtcgctcgccgacatcgttttgcaccctttgagaatgttgatgagtggttaaaggcgattaaggcagagtgtgagattaaacaagggaaagtggcaagacggattgggttttgataaatggaaaagtattagtatttaaaaaggcatagtagacaaagggcaggaataaaacctgcccttatacatcaattcaaaaagcaattactcttcgcctaattcgcccattgctgtgatgctaaaaccagcatcaacgtgcaacacttcacctgttacgcctgaagcaaggtcagaacataagaatgctgctgaattacccacatcttcaatcgttacggtacggcgtaatgcggcagtttgttcgaatgctgcaagcattttcttgaagtttttgatacctgatgcagcaagcgtacggattggacctgctgagatcgcattcacacggattccttctttacctaaatccgctgccattacacgagttgcggcttcaagtgatgcttttgccaaacacatcacgttatagttaggaattgcacgttctgcacctaaataagaaagggttaataatgctgcgtctttgtttaagaatggacgtgctgcttgtgccattgccacaaagctgtatgcactgatgtcgtgggcgatgcgatagccttcacgagttgcggcatttacatagtcgccatctaattgatcgcctggtgcgaaggcgattgcgtgaacgaaaccgtcaaatttttcccattttttgcttaattctgcaaagcagtttgtgatgctttcatcggttgctacatctaatggtaatacgatgtctgaaccaaactctttggcaaactcttcaacgcgtggttgaagtttgtcgtttaaataggtaaaggctaattctgccccctgtgctttcattgcttttgcaataccgtaagcaatcgaacggttgcttgctaaacctgttactaaaatacgttttccagctaaaaagcccataaatctgtcctctgtttaaataaaaagatgccaaattggcgaaaattgtggcgattataacgaaaaattagggtgtcgagcaaatataagcggtcagatccgagctgttttttgcaaattcaatcattttgccacaaaattttaacttttcccttgaaatcagccatttcacccttattatagagagtaattttttatagatttatatttcaatgtagggatacactgcgtgtgtccgtttgaatttaatatagtagacacacgcagtgtgttcctacatttgttatttaatttggataatcagagtagagaatgggtagaaaacgcagtgcaagttcatctcgttggcttgcagaacatttcaaagatcaattcgttcaaaaggcacacaagcaaaaacttcgttctcgtgcctattttaagttagatgaaattcaacaaactgaccgcttgtttaaacacggtatgacagtagtggatttaggggctgcgccaggtggatggtcgcaatacgttgtcacgcaaattggtgataaagggcgtgtgatagcttgtgatattttggatatgaacccgattgtcggggtcgattttttgcagggcgatttctgtgaggaaagcgttctaaatgcgttgttagagagagtaggggagggaaaagttgatgtggtgatgtcagatatggctccaaactttagcggtatgccttctgtggatattcctcgtgcgatgtatttggtggaattagcgttagatatgtgccgtcaagtgttagcaccaaaaggcagttttgttgtcaaagttttccaaggggaaggatttgatgattatctgcgtgaaattcgttcattatttaacgtagtaaaagtgcgtaaacctgaggcttctcgtgatcgttctcgtgaagtttatattgtggcgaccggctataaaggataatgtagcttatcctgtaaaattatagtaatcttaacaagtttttgattaaaaggaggtacaaaccttgaacgatatgtttaaaaatattttgctttgggcggtaattggtattacgttgatgacggctttccaaggctttgaaagcaattttaatagtgcgaatacagtggaatattcgacttttattgacgatctgaaacaaaaccgcctcagagaagtgaattttaagagtaacaatgaaacgattactgtggcaaaggttgatggttcagaatatcaaacggtaatgccgatgtatgaccgtgatttgttaaatgatctcttaaataaaaacgtcaaggtaattggtgaacctgcagaacgtcgtggattgttatcgcaaattttgatttcttggtttccgatgattatgctgattggtttctgggtgttctatatgcgtcaaatgcaaggcggtggcggtcgtggtgcaatgggctttggtaagagcaaggcaaaaatgattgcccctgatcgaatcaaaacacgccttactgatgtggcaggttgtgatgaagcaaaagaggaagtcgctgaggttgtggacttcttgcgtgacccaacaaaattccagaaattaggcggacgtattccaaaagggattttgatggtaggtcctcctggtacgggtaaaaccttattagcaaaagcgattgcaggggaagcaaatgtgccgttctttacaatggctggttcagatttcgttgaaatgtttgttggtgtaggtgcttctcgtgtgcgtgatctcttcgatcaagcgaagaaaaatgccccttgtattatctttattgatgagattgatgcggtcggtcgtaagcgtggcggtgctggttttagtggtggtcacgatgagcgtgaacagaccctaaaccaaatgcttgtagaaatggacggttttgagggtagtgaaggtattattattatcgctgcgactaaccgtgcagatgtgcttgataacgctttaactcgtccaggtcgttttgaccgccaagtgacggtagatctcccgaatgtgaaagggcgtgagcagattttgaaagtgcatatgaaaaaagtaccgcttgcaccagatgtagatccgatggttgttgctcgtggtactccaggttattcaggtgctcaacttgctaatcttgtaaatgaagctgcgttatttgcagctcgtcaaaataaacgtgttgtaacgatggacgattttgagaaagctcgagataaaatcaatatggggccagaacgtcgttcaaatacaatgacggaaaaagagattatcaatacggcttatcacgaagcgggacacgtgattgtaggttatttaatgccagaacacgatccactgaataaagtgaccattgtacctcgtgggcaagcattaggttttgcacagtttttacctgagggagatcgtgttagtgaaacctttactaaattagaaagccaactttctaccttatttgcagggcgtatcgctgagggcattatttttggtgaagataaaattaccacaggagcttcatcagatattcaccgtgcgacacaaattgcaagagcaatggtaacgcaatggggcttttcaaaagagctagggccattgttctatcaaaatgaagatggaatgggggcaattaagggcgtttccgaagcgtcgcaaaaattgattgaccaagagatgcgtaaaatcattgatcgtaactacgaacgagcgaaacagacattgttggataatatcgacatcttacacgcaatgaaagatgcgttattaaaatatgaaacgcttgatcgcaagcaaattgatgatttaatgaaccgcagacctgttggtgaaccatcaggctggagtaattcggggaacgatgatgaagataaagcatcaacggttcaagatgataaacctgaagaaaaatctgtggataatcaggatttaggcgatgcagttgcaagccgagaagcagaaggcaaactgtagttttctaataaaggcagagggtatcttctgcctttattattctcaaattgtattatctttcggcatagtagacaaaatcgttgctggttcagtaaaaactaagccccttaaaaaagcccttgtggttcgccgtcgtcagcttgtcgatatgcgagtagcagagctaaatcgtttgcaacaaagccacgaaacccagttggatgttgaataacttttttgtgtgtgaacacagttgctacgaaaacatttggcataatagaccaaaatgttggtgataattaaaggaaataattaaaaccagcacttttgtctactatgctaatattttaaattatccgttcatcaatacttccaactgctcttgaacttccagccattccatttcaacttcttccaactgttttttggttgccactcgctttgccaaagtgtctgtcaatttggctttattttccacgtcgtaaatttcgggggaagccagcgtttcttctagggttgttaaactagcggtgagcttctctaactctttttccaactgcgtcagctttttacgcagtggggcggcttgttggcgtaattcggcttcttggcgtttttgctctttgcggtttaccgcactgttttcattgtgacaagcggtcggattgtctgctttttttgcaaattccaactgagcatttagctcatttagccatttttgatagtcttctaaatcgccgttaaattcttccactttgccgtcgtgaactaaataaaattcattgacggtactgcgtaataaatgacggtcgtgggagacgatcaccaacgatccttcatattgtgtcagcgcttctgttaaggcttgacgcatatcgagatctaggtggttggtcggttcgtcgagtagcagtaagttcgggcgttgccatacgataagcgcaagcacaaggcgagctttttcaccgccagagaaagaactgaccgcttgtttgactttatcgccgtgaaacgcaaaaccgcccaaatagttgcgtagttcctgttcggttttttcaggggcaaggcgagctaaatgccacaaggcactttcatctgctcttaaggtgtctaattgatgttgagcgaaatagccaagttgaacgccttttgccagttgcgtatgccctgattgtgcttgaatttcccctgccagtagcttaatcaaggtggatttccctgcaccgtttcgccctaataaaccaatgcgagaaccaggtactaggttgagtttgactgattgcaatacggttctctcgccatagcctgcactgactttttccatcattaataaagggttaggcagtgaaagtggctctctaaattcaaaggaaaatggactatccgcataagctggggcaatcagttccattttttcaagggctttgacacggctttgagcctgttttgctttggtggctttggctttaaagcggtcgataaatttctgcaaatgggtgattttttgctgctgttgctggtaagctgcattttgttgagcgagtttcgttgctcgttggatttcaaacgaactgtaattgcccgtgtaatcaaacagtttttgctgttcaatatgcaagacacggtcgataatcggatcgagaaaatctcggtcgtgggaaatgagcaataaggtgccacgatagttgcttaaccagcgttcaagccagatcacagcatctaaatctaagtggttggttggctcgtcaagtagcaacaaatcggaacgacaaattaaagcttgagccaaatttaaccgcattcgccaaccgcccgaaaaggattttaccggcagttgaagctgttcggtgctaaaacttaaaccattgagtagggttgcggctctagattgaatggtccaagcatcaatggtatccagttgggcgtgtaaggtggcaatcaaattgccgttattctcaaggttggcttgctcaagttgggcagtgagttgggtatattctcgatcgccttggattacataatccaatgcagagatatctaatgcgggtgtttcttggtttacccacgtaatcgaccagtttttcggatagctggcatcaccgccctctgcttgtagttcattttttaataaggcaaacagtgacgatttaccacagccgtttttgccgattaagccgactttttgccctgtatgaatggtcgcatttgcttgttcaagtaagatggtttgaccacgttttaaggttaaatctgtaaaaaaaatcattgaaaattaaataagttgtttggttttagggtaaatttattgcacaataacgaagattttgttttatgaggaaaagtaaatgtttgattcgttagttgtccaattcgttgttctttgggcggtcatcgaccctattggctccattccagtttatttggcaaaaaccgttggtttatcaccagaagatcgccgtaagattgcccgtaatgcgattttaattgcagcagggattttactctttttcttggtgttaggacaatggctacttgatgcaatgcaaattccattatcggcattccaaattgctggaggcttggtattattgctttttgcattaacaatgatttttggtgaaagtaagccagatcaagagatcaaaatgaaaagtaatctacacgaattagcggtatatccgttggcagtgccgtcaattgcatcaccaggggcaatgatggcggtggtgttattgaccgataaccatcgctacagttttggtgatcaggtgattaccacggggattatgttatctgtactgttaattacctatattctctttttagtggcaaaccgtattcaacattttatcggacacgcaggggcggcgattattagtcgtgtaatgggtttaattctttctgcggttgctattaataatattttgctcgggttgaaagattttattactcaggcgcatatggggtgatgtattacttacaacaaaattatgtcataaatagatgtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttagcgttattggtttcggttttggtctttttctgatgggaaaaaccaatcacgaaattgcgtttagcaacatcaataccacaataaatcggagcgttcatcggtaacctgccttgtattcgggtttatatttcaactgttcggttttgctgatgaagttatccacgcctacgctacagaacgagttttagctctagggacacccaagctgtggataacgttatggtttatgttgctagtttactataattttaatatacaagggacacactgagtgtgtccatttaaaaaagactgcccctcacaatttggcggacacacgcagtgtgtccctactacttatattaaggaacacccaatgtctttacttccactttctcaagcactcgatacgatgctaaaccaactaccacgtccaacatcacaagagattattccgcttgatcaagcggtaaaccgaatttgtgccgaggatattttctcaccgattaacgtgccgaattttgataactctgcaatggacggctatgcggtacgaatggcagatctagaacattccactacgctacaaatcgcaggtaaagcctttgcaggtaatccgtttctagctgaaatgccacaaggaagctgtgtacgaattatgacgggggcaaaagtgccagtggaagctgatgccgtagtgatgcaggaagatacgacgctgaatgccgatggtactgtcaccattaatcgcttaccgaagaaattgggggataatatccgtcgtattggtgaagatgtgaagcaaggggaattggttctcgctaaaggtagcctattaaatgtagcaagcctaccactattggcttcactagggattgataaagttgctgtttatccacgtttgaaagtcgctattctttcaacaggtgatgaattagtgtctgttggaaatccgttacaagaaggacagatttacgacaccaaccgttttaccgttcgtcttttgctagaaaaaatggattgtgaaattgtcgattacggtattttgcctgatgatcctagtctgtttgagaagaccttcaccgaagtacaacaaaacaccgatgtgttaatcacaagtggtggtgtgtccgttggcgaggcggatttcaccaaagatgtcttggaaaaactcgggcaaattggtttttggaaaattgcgatgaaaccgggtaaaccttttgcatttggtaaattggaaaaagcgtggttctttggtttaccgggtaatcctgtgtctgctttagtcactttctatcaacttgttcagcctgcattattgaaactagcgggcagatccgatgaacatattgcaaatttttctcctaatctaaccgcttgtaccgcagttccacttaagaaagctgttggtcgccaagatttccaacggggctttttctatgcgaatgaaaatgggcaacttgaagtaaaaaccgttggaacacaaggctcgcatatttttagtgcgtttaatgaaagcaactgttttattgtgcttgagcaagaacgtggcaatgttgccgtaggtgagcaagtgactattcagccgtttaaccatttattgagataaacacaatcaatgccctttttttcatcaattaattttgttttataaaataaatatttgacacttatttagaaataggtagaatgcacaccgtttccaagaacaattcaaatgcgggaatagctcagttggtagagcacgaccttgccaaggtcggggtcgcgagttcgagcctcgtttcccgctccaatatattttcttagggcgtgttagcaaagcggttatgcactggattgcaaatccatgtagatcggttcgactccggtacacgcctccatatctaaatttataattacttataacgtattgacttttaagcaataaattatttcgctaaatgtatggcgtatgcatctatatcctagataaaagatcaccctagaggagtgacaatgctcattaatctacaacttgaacaaattcttgatgaaaaactcaatagtaaagccattgcagattatgctccaaatggcttacaggtcgaaggtcgccgtaaaattcgcaaaattatcacaggtgtcaccgctagtttacccttaattgaacaggctattgcgaaaaaagccgatgcaatccttgttcatcacggctatttttggaaaagcgaaaacccttgtattcgtggtatgaaaggaaagcggatcaaacaactgctagtcaacgacatcaatctatttggctatcatcttccccttgatatgcacgcggaattaggcaacaacgctcaacttgcaaaacatattggggtaaaaaacttacaaggtttggaagataaagctctctctattcccgtctatggtgaattagatgaagcgatttcagcacaagagttagcgaacagactagaaaaagctcttaagcgtaaaccgattttatgtgacgaatttattgcagattttccacaaaaattaattaagactgttgctatctgtaccggcggtggacaaggttatattgatttagccgcaaataaacagatcgatgcctttattagcggtgagatttcagagcaaacgacccattcggcacgagaacaaggcatttactattttgcttgcggacaccacgcaaccgaaagagatggtgtgaaagccttaggtgaatggctggcaaaagagtatggattagaggtcgaatttattgatattgataatcccgcctgataagccccataaagttactttctcttgaaacccaaaagcacttttgataggggtctgaacaaataaagttgttttcattgggggcatagcaactattttgtctactatgcctatatatttagccctttatgttatctctcttcccctcaacaaattccgtatccaggttcgatttgtgcttaacccttgcaaaatatcttggctaaggggaagcggttcgccacaaatttggctcgctaataattcgcccaataaaaaggcggtggttaaacctcgtgagccaagccctgcgactaaatagagatttggatagcagttggcagtttcaatcggctctcgacggcgaaattgattatacaagttagcatattgcgttttttgtgcttcaaaatccggcacagcccccaccatcggcacacgatctcgaaatgccgcacgaatgccgactttggcaagatttcctgaaaaatcaagctgttgcgtccattcacaagcggtcaaattctgctgaagttttgcaatgttttgctcgtgttccactaaactgaactgttcatcggcattgtctcttaaatggcttgccccgatacaatgggtctgttgagctgagctcggcgttaaatagccatcataacaaaccacacattttaacttcgacaaggcttctgtcgttgggatttggctgacttgcccgcgcacaggataaaggggaatgccttgactttgagtaaagtcagttaataaatgcccgtttgccaacactaaggtttgatgggcgaaggttcgcccttgatgttgccattgccattttcctgcaaaccactcagggttttccacctgatggtttaacaccactttcaaacctcgttgttgcaataaggtaaaagcattttgtacaaactgcacaggtgaaagccaaccgccctgagcaataaaagcaccaccattttgtaccgttaagcctattttttcactcaaatcttgagctgaacagagttgataaagttcactatcccaaccttgctccgccattttttgtagtttgtgtgcggttttatcgttataagcatataacgccacccctgaaaaattgtgttcaaatgtgaccacttgatccaactgcttaaaacgttgcaacgcataatcaaagctatgcacataaaaacgcacatttcgctcatcatcgtcgcttaactgtgggtaaatcgccccctgtaaattgcctgacgcattttttgctaactgttcatctttacaataaagtgtgacctgtttgccacgttctagcaaagacaaggcaacggcaaggcttgcaataccaccaccgacaatcgccacatcatcgctctctgtttggttagattgataaaaataaggaaagcgaatgctgttttctgtttgattgtcaggcttctcgccccaaagcatttcacgttttttgccgaaacctttacgttttttcacctcaaaaccgaccgcttgcaatccacggcggacattgcttgatgcggtaaaagtcgcaaaagatccgcccgcttgtgttaggcagaacatttgctgataaaggctttcgttccacatttcaggatttttgtcgggcgaaaagccatctaaaaaccagcaatcgatcagattgttataataatcgcccagttgtggcaaattctctaataggttgccaaaccaaatatcaaggtaaatttgttcaaaatggtaacgctgacacccaacctgtctaggttgccaacaagcgataagtttcgtggaaaaatctgcaaattgcggataatgttggtgaatttgctgtaattgttcggcttttatcggaaatttttcaaaagagataaaatagagccgtttaagtggtgaagtcggatattccgctaaaaatgccttaaacttttctgccacagcaaaaaaattcaaccctgtcccaaagcctgtttcggcaatcacaaagaaagatcgggtgtgtcgttgccatttttcccaaagttgattaccctcttgaaagacataatggctctccgccagcccatcttgcgtagaaaaataaatatcatcaaactgtgctgaaacaggggtatttgattgattaaaatttaaagaagcaaaggtaatttttgacatagcttatcccataaataaaaatggtgagccagtcacccaactcaccatttcataaaatgcaacattagaaaatgttgattgcaaacatcacgattatgcccaatgcaccaacgactgttaataatgcatagcctagtgtacccatttttatactcctgtagaaataaataacttagacattctaaggtgatttttgaaaaaagcaataaatatactattgttcctatatttcttaacagggcaaccgcatatgttgtccatttttcaacctacacgccgagcaacagctcatctcgaaattcatctgaccaaccagcagcggtcaatttccctttcatactctgctttttcgggtgtaatcgtgccaagttcaacgctaatcgacgcaagattgccagattttccgcaccccattcatcggtcacagcacattcgtcttctttatagaccacatctagcacccaatgggctttgttttccacttcccaatgccctcgcacgcacttcgccaatatttgaatatcaacatccaaactactgatataaaagactttttcttgcgattctttgccattatctgaccgcttgcgacacacctccaacaccgattttatccccttccattcctccgctttgctcagccaatcactcactttcagcttacggtagtaacgctcatcaattcgacgacgttccgcatttacctcctcaaacgtctcaagcatttcggggcaatctcggctgattttgtgaaaatacgcctccacttccgactgaaattgacggtgatttttcttcaacggcatcacataatcccctttcttttcgatgattttctcggcaattttcttctgtgtattcatcgcatccaccgttacaacggcattttttaagcaaaaactatcgataatttccatcaccgcctgctgctcattttgcttacccgaggattttttctgcgataaaatcaaaccacgagactggctccacacagtcacactgtgcaaagcactttgggtttccggattgaaactatgacgaagtgtcttgccatcaatcgcaatcacttcacgtccttgttgtgtgcgtatctcattgataaaattaagaaaaacctcattaaacgcttgaggctcaatgcgttttattacacgagcgatagtatcatcgacaggaataccacactcaaaaggacgatattttcgcaaccaatccaaatgtaattcgccaaaaagtttgatttcagtccagctgtttgcccccgacatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgtatttcttaagagattttcataaatggtcctcccctttttttcttctaagagctagagaattatttctatgtttagaaagcataaatattcaaaaaaatatttgtcattattacttaaacaacgtattatagccatctagacggaaaaacttctaaaacaaatttcttacaagcggtaagtattgacgtatttttttgcaatatcttactgcttgttgaatttcttagggtgcgttaatgcaccaaataacaatcatggtgcgttagttgcgtaccctacaaggaataattatggctatcaatctatttacatcagaatctgtatccgaaggtcacccagataaaatcgcagaccaaatttcagatgcagtattagatgaaatcctcaaacaagacccgaaagcacgtgtagcgtgtgaaacctatgtaaaaacaggtatggcgcttgtgggcggtgaaatcaccacttctgcttgggtggatattgaaaacttaactcgccaagtgatttgcgacatcggttatacccattcagatatgggctttgatgcacactcttgtgcggtattaaatgctatcggtaaacaatcgccagacatcaatcaaggtgtagatcgtgctaacccgttagagcaaggtgcaggcgaccaagggattatgttcggttatgcgacaaatgaaacggaagtgttaatgccagctccagtcacttacgctcaccgcttaatggaacaacaagcgaaagtgcgtaagtcaggcaaattagattggttacgcccagatgcgaaaagccaattaacctttatttacgaagataacaaaattaaaggcattgatactgtggtgctttcaacccaacacgcagaacacgttgatcagaaaaccgtgtttgaaggtgtgatggaagagatcatcaagccagtattgccaagcgaatggttaagccaaaacaccaaatactttatcaacccgacaggtcgtttcgtgatcggcggtccaatgggcgactgtggtttaaccggtcgtaaaattatcgttgatacctacggcggtgcagctcgtcacggtggcggggctttctcgggtaaagatccgtcaaaagtggatagatcagctgcttacgctgcacgttatgttgcgaaaaatattgtcgcagcaggtttagcagatcgttgtgaaattcagctttcttatgctattggtattgcagagccgacatcaattatggtggaaaccttcggtactggtaaagtgagtaatgaagtgttagtgcgtttagtgcgtgaacatttcgatttacgtccatacggcttaatcaaaatgttagatttaatccgtccgatttatcgtgaaactgccgcttacggacacttcggtcgtgagcatttcccttgggaaaaaacggataaagcagaagcattgaagagtgcactaagataatgaaaatattgaagtagattatactgggattagtctacttcaatcactttttaagcatttggttatgcggcatagtagaaaaagtgttggtaaaaagtgggctaaagccttataacacaaggctttaagcccactttttgaaatatgaacaaaaaactgtcctttttgccttaagaacaatatccaaaaatatcactgttccattagaactattcaacgttatattgaaaaatcccccaaagctaaattaattcctttacaacaaacctatctcaatattatttcagacgtgaccttctttggtcgtgaatttggtgtattagttttaatagataccttatctaaatcaccgctttcattagatttccgcctattatttctaactttatattgataaaagttgaaaaattcctgttattttatctttacattgtttttttttttacaatgggagggttcatttgtgcatcctgaaaatgtaaataaaggtttatgatgcttattaggaaaagcgttagagaagattattatgaataaaatatttagagttatttggagtcatgttcaacaggcttgggtggttgtatctgagttagtaaagtctcataccaaaacatccacttacacggataaaagagctcaagtatgcacctcagattattttttagataaacagcaagataaatttaaattaagtcttttaagtctagtattactaagtatattttttagtccagtaggtttagctgcatatcttcaagatggttctgaaagaggaagtgacgctgacaatgctactattggtattggtcaaggtagtagggttgggcctggttctattgccatcggtcaggacgcaaaagctgaaggtaggactagtattgcgataggttataaagctgaaacaagcggtgacaaagccgtagccgttggggcaactgcacaagcattcaattattctgcggcttatggttatggcgcacaagcaaaagcaataggcgctgttgcagtcggtcaagaagctattgcaaatcaaaatggaggcgttgcattgggttaccaatcatctgttaacgttgtcaatggtgttgcattgggttctttctctagcgcagatacggtagggaatattgaaggagcaaaacaaactttttctgtgacagaggaagcaaaaactgttgagaatggatttaaatctacagaaaatattggtgcggtttctgttggtagaagtcttgcttggaagaatttcaagacaccaatcaaacgccaaatcaccaacgttgcggcaggtacgcaagataccgatgcagtaaacgtggcacagcttaaatcgctcaccatgcaaataggaggcgataacaacagcagtggcaaggtaggcatttggagtggtacgctcactgtaaaaggagaaaatggtattacttcctctgctaatggcagtacgattacggttagattagaggacgaactcaaaaataaaattgataggattgccgctatgggtaagttaattaaaagtgcggaaaaagaaccagatggcaatctaaaaattacctatacagataattcgcatagcattatcgagaaaggtgaaaaaggagatcgtggtgaaaaaggagaacgtggcgaaactggccctgcgggtccagcggggccacgaggccctgcgggtgagcgaggccctgcaggtgcagctggtcctagggggacagagggtccgaaaggtgatacaggtgagagaggtgcaactggccctgcgggtccagtaggtccagcgggaccacgaggtgcagctggtcctgcaggtccaaaaggagaggcaggagcaaaaggcgaaactggtcctgctggagcaagaggaccacaaggtgaaaaaggagctcaaggtccgatgggtccggcaggcccagcgggtgctcagggcatacaaggtccaaaaggtgatagaggcgaacaagggcttccaggggtagcaggtcctaagggcgatagaggcgaagctggtccagtgggtccagtaggaccacgaggccctgcgggtgagcgaggagaaactggccctgcgggtccagtgggacctgctggtccaaaaggagaaataggccctgcgggtccaacaggggctaagggtgaaccgggtcctagaggtgaacaaggtattcaaggacctgcgggtccagtaggtccagctggaccacagggtgcaacaggaccaacaggtccagcgggagagccaggcaagcagggtcctaggggggaacaaggtgcacctggtcctgcaggtccaaaaggagaggcaggagcaaaaggcgataagggtgaccctggtgaagcgggaccagtcggccctcaaggtcctgtgggtgcaactggccctgtgggtccggcaggcccagcgggagagcgaggcgagcagggtcctaggggagataaaggtgaaactggtcctgcgggtccagcaggggctaagggtgaacagggtcctagaggtgaacaagggcttccaggggtagcaggtcctaagggcgatagaggcgaagctggccctgcgggtccagtaggtccagctggaccacaaggaccgcagggaacagcgggtgctcagggacagaagggggataaaggcgatccaggacaagcgggtcctaaaggagaaaaaggagatacaggtcctagaggcgaagctggtcctgcaggtccaaaaggagaggcaggagcagtgggccctcaaggtcctgcgggtgcaactggtcctaagggggataaaggcgatccaggacaagcgggtcctaaaggagaaaaaggagatacaggtcctagaggtgaaactggccctgcgggtccagcgggacctaagggtgacaaaggtgatacgggtccagcaggatcacaaggacctacgggtccaactggaaattcggaattaaaaggcattacgtcgattgccaatggtaacgacgccaccaaggcgaatggggctaagattaccttgtctacaggttctacaaataaaacagttaatgttaatgatgcgaaaattaccaatgtggcagctggtgtagcagataccgatgcggtgaatgtgaaacagttgaaatctgcgaaaactgaagtggaatctaccgatcacagtgcggtgattaaagagcgtcagggcgataatcagcaaatcgtgtatgatttggcggttgctaaaacgaaactcactgcctctaaggataaacgcaccattagtgcagcagataaaggcaaccattttgcgacaggagatgaagtcgcagtagcaattaataccgcaacagcagccgcaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaacttctgataatggcaaatggcttattcgagcgtctgttagcagtaatactcagcgggatactatgattggaggaggggtaagttttgtgtggtaatctagcacctataaattagaatttcatgctcaatgccattgttattttaacaatggcattaatatctattggatttaatttatttgtggaagaaaaggttttatgacaggacgaacaaaagtatctctgaatattatttttctttccatgcttttggatattgtgcttaaggcaaaaaggacagttttttgttcatatttcaaaaagtgggcttaaagccttgtactataaggctttagcccactttttaccaacacttttgtctactatgccttttatgctattgacttaatactttatcatttctctttttgccattactgtagctagttttagctattttgtagtacggcaatataattacaatttatatccttattgatccaaaaattctttgttaaaggattaaaatggtatccgacgatttctttacattcaaaatcttcttgagagcaccatcttagcaactccgagggtttaataaatttttcgaaattgtgagtgcctttaggaagcattttgagaacatattccgcgcctataataatcaacatgtatgctttcgctgttctattaatggttgaaataaagagtaaaccatcttcctttaataaattcttacaactctgaataatagaatgaggattgggtacatgttcaagcacctccatacaggtaataatatcaaatttttcagtatccgttatacaatgttgttttagaaagtcttctacagtaatttgctgatagcaaatatttaagtgattagattctgcatgttgtctagcaactagtagagcatctgctgccatatcaatgccagtgacaatagctcctaaaccagccattgattcgcttagaattcctcccccacatccgatatcaagtactttttttccaaatagcccatttgttttgtcattgatataggcaagccttagtggattaagtagatgaataggcttaaagtctccttgaggatcccaccaagtttttgccattttttcaaatttctccacttcttgttgatcaatattattcataaattactcacgattattttaaagtagaaaataattagattgagagaggaatagaggacattgtgatttattcaatacttacagaagtaatgactatatcatgtttagggacatcagtatgccatccataattatgtgtagagataacttttattttatctacaatatccataccatctacaacttctccaaaaacagcatacccccattcttgaactacagttttgccaaatagttcttttgttcggtagtctaagaaagcattatctacaacattaatgaaaaattgtgaggtggctgaatgaggatctgctgtacgagccatcgcaatactaccccgtttattacttaaaccgttacttgcttcatttttaattggttctctggttggtttttctatcattcctacttccatacctccaccttgaatcatgaaattatcaataacacggtggaaaatagtattattgtaaaaaccttctttacaataagactcaaaatttgcagaagtaataggtgctttctcaaaatttagcataattttgatatcaccaagattagtatgtaatataaccatttttattccttaaatatgaaatgtaagtagaaacacagtatattattataagttttgacgaaattacaaaaactttcttaatggctaacgaaattacgtatgttcgatgatattttttacccaatccaaccccgaataaaaatcctcagagagataaggtttgagtttttgcaagttttcaatgataacggttttatcagggtggcaaaggttaatatgccccaattttctgcctgctcgaacttcttttccataccaatgcagttggctaaatggaatatctaaccattcattatgatgttcgatcccaataaggttcaccattacacttggtgcaataggtttaagctctggggttggtaaatcaagtaatgcacgcaaatgcaattcaaattgactgattgaacagcctaactgcgtccaatgtccactattgtgtacgcgtggagcgagttcatttatcagcagtttttcgcctactacaaaacattccattgccattacgccaacataattgagttcgtgcataatcgcagaaagcatttgttctgcttgttgttggaatatttgctgatggggtagtgtgatatccgtaacactgtaacgcaaaataccgttttgttgtaagctatgggttactgggtagaaacgggtttgaccattacggaaccttgcacccactaaggaaacttcgccatcaaagggaataaatttttctgcaattacgtcaccaaataaatcagaggtaatttgttcgacattatctttagtgacaatccactgcccacgaccgtcatagccccctgtacgacgtttcactaccactttttcaccaatgttttcaaagacttgctgccattgctcaggagaacttaataactgccaaggcgatgtagagagattaagctgatcgagcaatgatttttgggtaaaacggtcggcaagttgtccgaaaacggaaagattgacaaagtttttatggttgctcaataaatttgttaaaggcgtttctgcccaacgctcaatttcagcggtaatcaaactgttttctgcgagatcgaatacgggatcgtcaaaggctaatggctggacttcaatatccaaaggcatacctgcataacgtaacattctgccaagttgcccgttaccaagaacataaataggggggtagagtgtgcttttttgcatagttatccttaatagtagggacacactgcgtgtgtccgtgacaaatattgtattgagtacccaatagaaatacggacacacgcagtgtgtccctacgtttaattatttaaaaatattccgccaacggtttttccaacgtttgattcaacaaaaccatcaacttaatgcgagctttctgtccgcttaatccttgggtgaaaatgaccccttgttgtttcagttgcttaccgccaccaagataatcatacacatcttgcgtaataccgttaaaggcacgggacaccaataccactgggatatttgcatttaatagggcggaaatccctgctagacaagatggcggtaggtttcctgcccctaaagcttcaaccactacgccgtcacaacggctttgagccagttgttctagtaagaagctatccataccgacataggctttgaccagttgaatgtttgatttttccaaacgatcaatcggaaagcgttcgtaagcggtcagatgttggaaataaattgcacggtttttggtaaccaaaccacaaggcccaaatgtgggcgtttggaaggttgctacgttagtggtatgggttttggtcacaaatttggcattatgaatttcatcattcataaccaccaaaacacctttgttttggctttcatcacttaatgccaccaaaatagcactttgtaggttaattaaaccgtcagagcctaattcattgctagaacgcattgcccctgtgatggcaacgggaacattcactttcaaggctaaatcaaggaaataagccgtttcttctaaggtgtctgtgccgtgtgtaatcacgatgccatcataaccttcggctaacactgcctgttcaatccgatcttttagcaactgccaatgtgccaaggtaatatggggcgaaggaacgtgcaaaatcgcttcttgataaagttgagcagggtgattgagtttagctaacgccgttaaaagtgggttttgagctgaaggcgatactttgccgtcttcgccttcgctcattgaaatagttccacctgtgtggagaattaataattttttactcatttaaattcgtgggtctggattgtctaacacagattgtgtttgttcattgcggaaagatcgtaattttagtgcaatttcagggttaaatgcacctaaaatttgtgccgctaataatcctgcatttgcagccccagctggaccaatagcaagggtgccgacaggaatgccttttggcatttgaacgatagagtaaagactatccacgccactgagcattgagctttttacaggtacacccaagacaggaacaatggttttcgctgcaatcataccaggtagatgagccgccccgccagctcctgcaataatcactttgtaacctttttgttctgcggtttcggcaaattcaaacagtttatcgggcgtacgatgagctgaaacgacttcaacgtgataaggaatgttaaattgatcgagaatttgggttgcttcggacatagttgcccaatcgctttttgaacccattacaatggcgatttcgatgttggttgtcattttgtccctttggattgagtgtaatacaagcggtgagaagtgtatcacaaaaagcaaacgtttgcctaaagaaataatctgtgatgaagctaacattttaggctttgaaaaatagacaaaataagtggtttttgctatcttgaggtcaaatttgtctataaattttcaacaatttttgataaatcaaaaaaaagtctttgaaaatcaaggcgatagacgctttcctaaaagtagctctacgaatatcagtagggctatttgccgtgttttattgatctaaaacaaaaataaataacggacttttggttaaagtttcaacggttggcaaaattgtaacaattttgcaatgttttattcatcagagaaaaaaaggaaaagactatgtcagaaatgttagcacatgacgtagatccattcgaaacgcaagaatggttagactcagtaaactctttagttaaagaagagggcactgagcgtgctcaatttattattcaacaagtaatgcaacatgctcgcactcagggtgtagggcttccatcaggcgtaacaactgattatgtaaacaccattccagtgtctgaacagcctgtttatccaggaaatcaagaaattgagcgtcgtattcgttcagcagttcgctggaatgcgattgcgatggtgttgcgtagtcagaagaaagatttggatctcggcggtcacatttcaaccttccaatctgctgcaaccatgtatgaagtgtgctttaaccacttcttcaaagcagcaacagataaagacggcggtgacttagtttattctcaaggtcatgccgcaccaggtatctatgcacgttctttcttagaaggtcgtttaaccgtagagcaattagataatttccgtcaagaagcttttgctgatggtttatcttcatacccacacccgaaattaatgcctgaatactggcaattctctaccgtatctatgggtttaggtccggttaatgcgatttatcaagcacgtttcttaaaatatttaaataaccgtggtattaaagatacatcaggtcaaaccgtttatgccttcttaggtgacggtgagatggatgaaatcgagtctaaaggtgcattaaccgttgcaggtcgtgaaaaattagataacttgattttcgttattagctgtaaccttcaacgtttagacggtccagtaaatggtaacggtaaaatcgttcaagaattagaaggtttatttacaggtaccggctgggaagtcatcaaagtcttatggggtagcaactgggataaattattcgctaaagatacgtcaggtaagttagcacaattaatgatggaagtagttgatggtgactacttaaccttcaaatcaaaagatggtgcttatgtacgtgaacacttcttcggtcgttatcctgagactgctgcattagttgcagatatgacagatgaagaaatttggaaattacgccgcggagctcatgatacagaaaaaatgtatgcagcatttgaacgtgcaaaacgttcaaataaaccagctgttatcttagctcaccaagtaaaaggctataaaatccctgaagcagaaagtaaaaatactgctcaccaatcgaaaaaaatgtcattagatagcttaaaaggcttccgtgactacttccatttaccattaacggatgaacaagtagaaaacttagaatatgtgactttcccagaaggttcagaagagtacaactacttacacggtcgtcgtaaagaattaaatggttatttaccagcacgtaaaccgaaattcgatattgagtaccaagtacctgcattatcagaattccaagcattattagatgcacaaccacgtggcatttcaaccacaatggcattctctcgtgtattaaatatcttattaaaagataaaaatatcggtcaaaccatcgttcctatcattgcggacgaagctcgtacctttggtatggaaggtttattccgtcaaatcggtatttataacccacatggtcaaaactatgtgccgtcagaccgtgatttagtggcttactaccgtgaagcaacagatggtcaagtgttacaagaaggtattaatgagttaggtgcaacggcatcttgggttgctgcagcaacttcatactctgtaaacaaccaaccgatgatcccattcttcatctactactcaatgttcggcttccaacgtgttggcgatatgatgtggttagccggtgaccaattagcacgtggctttatgatcggtggtacatcaggccgtacaactttaaacggtgaaggtttacaacacgaagatggtcatagccatatccaagcagccgttatcccgaactgtatcacttacgatccagcatttgcctttgaagtggctgttatcgttcaagacggtatcaaccgtatgtacggtgaaaaacaagaagatgtgttctattacctcacgacattaaatgaaattaccgaacaaccagcaatgcctgcaggtgcggaagaaggtatccgtaaaggtttatataagtttgaaacagtagaaggtaaaggcaaaggtcacgttcaattgttaagttcaggtgcaatcatgcgccatgtacgtgaagcggcacaaatccttgctaatgaatatggtgtcactgcagatgtcttctcagcaccttcattcaacgaattaggtcgtgacggtgcggatgcggctcgttggaacttattacacccaacagaaaccccacgcgtaccttatgtttcacaagtgttagcagatttaccaacagtcgcttcaactgactatatgaaactttacgcagaacaaatccgtgcgtatgtgccaagcaagcactaccatgttttaggtacagacggtttcggtcgttcagacagccgtgcaaacttacgcgaacacttcgaagtagatgcacgttatgttgttgttgctgcattaagtcaattagcgaaagaaggcacagtagaaaccaaagtggttgctgatgccattgagaaatttggcttaaatgtagatcgtattaatccgttatacgcataatcaaatcgtcgaataaatgtagggacacactgcgtgtgtccgagaaatttggcttcgatattcaacggacgcacgcagtgcgtccctacaagtggtgtgattaagtaaattttttacaaatttcaccgcttataagaaggattacaaaaatgtcaaaacaaattcaaattccagatatcggtggtgatgaagttaccgtaaccgaagtgatggtcaaagtgggcgataccattgctgctgaccaatctattatcaatgtagaaggtgataaagcctctatggaagtaccagcaccagaagcaggtgtggtaaaagaagttttagtgaaagtgggcgataaagtgaccacaggttcaccaatgttagttttagaagcagcaggttcagcaccagcaccacaagcggtcgcagaagctgcaccagctccagcggcagcaccgacagcgagtgcagttgttgatgtcaatgtaccagatatcggtggcgatgaagtcaacgtaactgaaattatggttaaagtaggtgataccgttgctgttgatcaatctattatcaacgtagaaggcgacaaagcatctatggaagtgccagcaccaatcgcaggtgtggtaaaagaaattttagtgaaagtcggcgataaagtttcaactggcaaattagtgatgcgttttgaagttgcaggtgcagcaccagtagtgactccagcacctgttgcagcagcaccagctccacaagcgggtggttcaacgatcaaagaagtgaatgtaccagatatcggtggcgatgaagtcaacgtgactgaaattatggtgaaggtgggtgatactgttgccgttgatcaatctatcatcaacgtagaaggcgataaagcctctatggaagtgccagcaccaatcgcaggtgtggtaaaagaaattttagtgaaagtcggcgataaagtttcaactggctcattaattatgaaatttgaagtcgcaggtgcagcgccagcggcggcatctactccagctccacaagaggcggcagcgcctgcaccagttgcagtggcgccagcacaatcaggtaatgtgtctggtttaagccaagaacaagtggttgcaagtgcagtttatgcccacgcaaccccagtgattcgtcgcttagcacgtgagtttggcgtaaacttagatcgtattacaggtacaggtcgcaaaggtcgtatcgttaaagaagatattcaagcttacgtgaaaactgcggttcaagtatttgaagatgtgaaatcaggtaaagctccagcagcaggcaatggcgtagcgaacggtgcaggtttaggcttattaccgtggccgaaagtcgatttcagcaaatttggtgaaattgaagaagttgaattaagccgtatcaataagatctcaggtgcgaacttacatcgtaactgggtgatgattccacacgttacacactttgatcgtacggacatcacagatttagagaatttccgtaaagaacaaaacaaactggctgaaaaacaaaaattagatgtgaaaatcacgccagtggtgttcattatgaaagcggtagcgaaagcgttagaagcgtacccacgtttcaacagctcaatttctgaagacggtcaaaaacttacccttaagaaatatattaatatcggcgttgcagtagatacaccaaacggcttagttgttccagtatttaaaaatgtgaacgagaaaggcattgttgagctttctcgtgaattaatggaagtgtctaagaaagcgcgtgaaggtaaattaactgcagcagatatgcaaggcggttgtttcaccatttcaagcttaggcggtatcggtacaacccacttcacaccaatcgtgaatgcccctgaagttgcaattttaggcgtatcgaaatcagaaatgatgccacaatggaacggtaaagagtttgagccacgcttaatgcttccgttatcattatctttcgaccaccgtgtaattgacggtgcggatggtgctcgtttcttaagctacattaacggtgtacttgcggacattcgtcgtttagtaatgtaattgatataagcggtcagatttgcaaaattttctgcaaaaaagaccgcttattgtagggacgcaatgcttgcgtccgcggacacacgcagtgtgtccctacataagaggaaaaattttatgagccaagaaattaaaacacaagtagtggtactcggtgcaggtccagcaggttattctgcggctttccgttgtgccgatttaggtttagaaacagtcttagttgaacgttattcaacccttggtggtgtgtgcttaaacgtaggttgtattccgtctaaagcattattacacgttgcaaaaatcattgaagaagcaaaacgcgcagagcataatggtattacatttggcgaaccaaccattgatttagacacagtgcgtgcaggtaaagaagcggtagttgcaaaactgactggcggtttagcaggtatggcaaagtcacgtaaagtgactgttgttgaaggtcaggcaacctttgctgatccacatacgctagttgctcgtgaccgtgatggacacccaacaaccattaaattcgacaatgcgattattgcagcaggttctcgcccaattcaattaccatttatcccacaccacgatccgcgtatttgggactcaacagacgcacttaaattaaaagaaattccgaaaaaattactcattatgggtggtggtatcatcggtttagaaatgggtacggtatatcaagccttaggttcagaagtggaagtggttgaaatgttcgaccaagttattccagcagcggataaagacgttgtagcaattttcaccaaacgcattgagaagaaattcaaattaatgcttgaaactaaagtgactgcagttgaagcaaaagacgacggtatctatgtttcaatggaaggcaaagcgtgcaacgatactaaacgctatgatgcagtattagtagctatcggtcgtgtaccgaacggcaaactattagatgcaggtaaagcaggtgtgaatgttgatgatcgtggctttatcgcggtagataaacaaatgcgaactaacgtgccacacatcttcgctatcggtgacatcgtgggtcagccaatgttagcacacaaaggtgttcacgaaggtcacgttgctgcagaagtaattgcaggacaaaaacattacttcgatccaaaagtgatcccatctattgcttatactgagccagaagtagcttgggtaggtaaaactgagaaagagtgtaaacaagaaggcttaaactacgaagtggcgaagttcccttgggctgcttcaggtcgtgcgattgcgtctgaatgtgcagacggtatgacaaaattaatcttcgataaagatacacatcatttacttggtggtgcaattgtgggtactaacggcggtgaattgttaggtgaaatcggtttagcgattgaaatgggctgtgatgcagaagatattgcattaactatccacgctcacccaactctacacgagtctgtaggtcttgcagcagaggtatttgaaggctctatcacagaccttccaaatccaaaagcgaagaaaagataattagagcgcaataaaacctctcggaatgagaggttttatactaatatgtaacctcttttttctcagaaattttcccatttccctgctaaaatatgccttgtaaatttaatgtgtttttacaggatacccaatgacagaactcaaccaccaaatcagccaaattattgccgcagagttagcggtgcgatctgaacaaatttttgcagcgatgactttacttgatgaaggaaataccattccgtttatcgctcgttatcgtaaagaagtcacaggcggattggacgatactcaacttcgccattttgaaactcgtttgctctatttgcgtgagctaaacgaccgccgtcaaactattttgaaatccattgaagagcaaggcaagctcaccgatgaactgcgtgagaaaattgaacaaacgcagagtaaaacggagcttgaagatctctatttgccgtataaaccaaaacgccgtactcgtgggcaaattgcgattgaagcagggcttgagccgttggcggatagtctttggaacgatcctagccaagtgcctgaaacagtcgctgaagcctatgtggacgcagaaaaaggtgtggcagatgtgaaatctgcacttgatggggcaagatatattttgatggaacgtttttccgaagatgcggatctgcttgcaaaattacgtcaatatctgatcgctaatgccacccttgaagccaaggtgattgacggtaaggaagaagaaggcgagaaattccgtgactattttgctcacagtgagccgttgaaaaatgtgccgtcacatcgtgctttagcgatgttccgtgggcgtaatgaaggtattttgtcgcttaatttgaatgcggatcctgatgcggaagaaggtagccgttcaagttattgtgaagagattattcgtgagcatttaggcgtacaacttcgccagcaaccggcagacagctggcgttcgcaggtgattgcgtggacatggaaaatcaaagccttgttgcaccttgaaacggaattaatgggggcattgcgagaaaaagcggaagaagaagcgattgatgtgtttgcacgtaatttatccgcattattaatggctgcaccggcaggggcaagaaatacaatgggattagatccaggtttgcgtactggggtgaaagtggctgtggtcgataatacgggtaaattattggataccgccacgatttatcctcatacaggacagatgaacgcggcaatggtgaccatttataagctgattaaacagcataatgtggatttaattgcgattggtaacggcacggcttcccgtgaaacggaacgctttgccaaagaagtgattaaagagatcaaagagaataaaccgcaaactgtggtggtgagtgaagctggagcatctgtttattcggcttcagaattggcagcaacagagttccctgagcttgatgtatccttgcgtggtgcggtgtcgattgctcgccgtttgcaagatccgttggcggaattggtgaaaattgaacctaaagcgattggcgtagggcagtatcagcacgatgttaatcagtcgcaactggcacgtaaactggatgcggtggtcgaagattgcgtaaatgcggtgggcgtggacttaaataccgcttctgcaccattgcttgcgcgtgtggcaggtatgacgaaaaccttagctcaaaatattgtggcttaccgtgatgaaaatgggcgttttaattctcgttctgacctgaaaaaagtcgctcgcttaggaccaaaagcctttgagcagtgtgctggttttatgcgaattttaggcggaaaaaatccgcttgatgcctcaagtgttcacccagaagcctatcctgtggtggaaaaaatcttgcaagcaaccgcttctacgttaggtgtgttgatgggtaattcaacgaaaattcatagtttgaatgccaaagattttgtcgatgaacagtttggtttgccaacggtaaacgatattttcaaagagcttgaaaagccagggcgtgaccctcgtggtgagttcaaaacggcaatttttatggacggcgtagaagaaatcagcgatttgaaagtcggtatgattttagaaggcactgtcactaacgtaactaacttcggggcgtttgtggatattggcgttcatcaagacggtttagtgcatatttcaatgttgtcgaacagctttgttgaagatccgcaccaagtggtgaaaacaggtgatgtggttaaagtgaaggtgttagaagtggatgtggctcgtaaacgtattgccttaacgatgcgtttggacgataagccaacggataaacgtgatacaagcggtgagaaacgcaaagagtttggcaaatccgaccgctcgcaaaagcctgaacgtcaaagttttggcaacaatgcttttgcagatgcgttgaaggggtggaagaagtaatctacttttttggtcgggacgatgacaaagtaatttggagcgttcttaccaccatctcactttgcctttgcttctgtcaaatttttcttgtttaattcaagtatctttgacatgttatcaggttatgctattccaccttccctcgtaagagggaagtgaaagaaatgctatataagttagccccctaacgctttcaatactaccgtcatatgtaatccgtaaaacaaggttctaccgagtaattcgccgatcaggattaacgcaaatccgctgaagctgatgagtgtagtgcgttttttcagtgctactagcaataagacaataccgacaataatcaatccaaagtggataaaggtgatagtgagataatcaggtacgagatctaatgcagtgaatatcgccgtttttacccctaagagatattgatagttcaagtaggtgctaattgcagtggcaatcgccccaacgattgcaataccaaccaaggttttttgtaaatactcaccgcaacgtaccgcttgtaataagccgactgccaaagcagaaccagctaatacaaccgttaagaaaaacgatactggcgtatagacgctattctacgttggcacagttgggattaggtagagttttgccattgccccgataaaaattaaacctgaaatagcaaccactacatgccctaacggttgccacgctgttggtagtttgtgttcaatagatgaaacaaagctaacaagcggtaagtttgggcgatctttttgcaaataacggctgaccgctaacgcccagtaagccgagccaagggcaaagaacgcggaacctgttgcgatttcattacttaaatccgacgtaccaacacggtttaacgcattaaatgctcgttcaggtgaacctaaatgggtggtagacgcaataaagccgattgccattaatacccaaagggctgccataatgtaatggattttgtttactgctgttttaccttgtgctgtcacaagcagtaagctaagtgcaataaatgccccaacaactgtttgagccagtacggtaaaaaagactaagggtaattcgtgtaatccagcacccattttatacctcctttggattggctaagaaaccgccttgatagttggtcggtttggcgttgttatttaaacgtaatgcaatgttcggctgggtgtaactcgaatctggtaacggagcgacatcacgaatttcaccatattttgctttaagttcatcgatcggtaatagatctaacgcacgcaatgggcaagatttgacgcacattggttttaaaccttgttcaactcgttcaaaattgcctgccgaaccgtccatacagaagtccatctgctctgaagtagtacagtctggtaagagaatatcggcacatttttcggtcgatgtcatatggttatcaatcaccactaacatttcaagcatactttcatcttgcaaaatatctagggtacggttgatgtctgagtgttgattgataatacagttgcctgcgtagttcaggataaatttaatcggctgattgagcttctctgcaccttttaaaccatcggttaaagcggtcatttccttgccacgagttacggcatctgtccacataaagataggaattttggctttaatcgggttctcgcccacaggcaaacgcacaaacggcattgtatagaaaccttcacgggatccgctgttgccaccactaatccccacgttacctgttaaacaggctaacattgcgatagcacgggcggcttgttcgccgttagcatgacgttgtgggtccccaaccttgacagatataagccggttttgtggtcgcaatttctcgtgcaaggctgataatacgctcttttggaatagcggtgattttttctgcccattctggcgtttttgccgtttgatcgtccccttgcacaagcacgcacttggtggaaatcgtcgtaattgtctaaaccaagattatcagtttctacatatttaatcactccatcttgaacgtgcatacgcaacgggcaacggctgtggcagtttacggtacaagcactccaaacaagtttttcattcgctgtagaagcggttggttttggattagcttttgcaattggaatttgaacagcacttgctgcaagtgccgccccacttaacgcagcatcacctttgagaaacgaacgtcgttctgccgaaaaatggctgctgtctgattgatgtttcatataatttccccacaaaatagaaaattgacccgattaagtcgttcgtagggaatatagagatttccgttgatgaagttttgacgattatcaaattgctcaggaagttagacgataacgctttaggttgagattattacgttatttactatgttatatatcgattggtaatgtgtaacctgaaaatcaaacttgcaatttattatagctcggctatgctagtggcttattttgttttcatttttaagtagttatgtcacatcaccaccccgtcaaaggcgctattgcaattattaccgcaggctttttatttgcttgtgtcaatacgcttattcctaaattaacttccgtttcaacaattgatgccagtgttattgctctggtgcaataccttgttgcttttgtctttttaatgccaagtatggcaaatatgggcttttttcagtcgttgaggacgaagcattttggtatgcactgttttcgggtgtttttgtcggcaatcggtattcagtgttggacaatggctttagcttatcctattcccatttggcaggggattgcgttgttgatgacatcacctctgtttgtaactattggctcagggctgtttttgaaagagaatgtggatacaaaacgctggattgcgactttcttgggatttgtgggggcgatgattattttagagccttggtcagaaaattttgagtgggtggtgttattgcctgttgctgccgcatttttctgggcgtgttattcgttgatggtgaaaaagctctctagcgaagattcgccaaccacaatggtagcctatctatttattttaattaccccatttaacttgttgatcgcattgacgaatttaagccctgaaggatttagtttgccatcatttagtgattttggtttcttaattttattgggattttttaccgcattggcacagcttgctgtcgctaaagcctatagtttggtcgatgcttcttatattcaaccttttgattttattaagttgccattgaacgttttggcaggttggcttgtctttaactgggtgccgccaggtaagctatggttaggggcagcaattattattggggcgacgatgtatattacacacgccgaagcgaaacaatctcagcagaagtagatgatggcggaacaatctcaaacagagcaatcgacagcaaaaacaacggggagacgttgggtagctcgcgtaagcatttggctgatgaaaggcatattgggattgtgctttcctctttttttgctgatgtttgctattgattttgcaacaggctattgggtgcgagatcaaatttatattgatgtacgacaattaccccaacgggaatatgcgttggttctgggaaccgcaaaatattatccgtcaggctcgcctaatctttactacaaatatcgtttagatgcagctaaagcggtatttgagcataacaaggtcaattatttattagttagcggtgataataagaccgcttactataatgagcccaaaatgatgacccgtgatttacgccaaatggggattccgtggcagcgaattagacaggattatgctggttataatacgttagattcgattattcgggcggataaagtgtttcaattacaaccctttatcatcatttctcagcagtttcattgtgaacgagccttattcattgcaaaatttcaccaaattgaagcggtctgttttacggcaaaatatccagatgctcactataaagtgcggattcgtgaattttttgcacgaagtgcgatggcggtgagtttattgttagggaaagaggcgacaaccttggaaccttcacagatgaagatgataaaaaataattaaattcctgagtataggcatggattgatttatatcacccttttctattttttccagttagtgatacaatctgaatttatttttattcactaattacattatgagtcgtcaaaagaaaagtcgtcgtcttaccgacattatgcctgcaagaaaggcagataaacccttacaacctaaagcaaaagtgtctaagggccgtaaaccaacacgttatgaattagatttagctgcgcgtgaggaaaagaaaaaacgtaaacataaaggtttgccgtcaggctctcgcactaatgaagggaatgagcaaaaacaaaaagtagagaaagaggtaaaagatccgcgtatcggtagccgtaaaaaagtgccgttaatggtggaatttgttaatcaaccagaaaaagaccgtgttattaaacctgtgccaattgaagttgagaaacctcgtttaagtccagagcaagagttagaacagttagaaaataatgaatgtttaaatcagctattagacgatttagaagcaggtaaaacattgtctgcacaagatcagaaatttgttgatgaatgtttagatcgcgttcacgaattaatgactgagttagggattcaagatgaagaagacgaatcagaagatttgctgcgtcaatttgaaacgatggacattaataatttccgttaaaaatgatgatgcgattttttctaattattttggcaattttgattgtgctgtcgatggcaggttacgcaatttccttatggcttaaattaaaaaaacagaaaaaacagttaaaagaggcacaacttaatcgctatcgttcgattatcgagagcattgatgtcattggacgagcaatgttagctgagcaatgtggtttttctgaaggggtattacgattaaaaccattacttgatgtactaggcaaaaaattaagtcaatatccagcaatgtggtcattgtatcaagtggttgaatcaatgccaattttagaggctcgtaaggaattaaaacgtaatgagcgaatgaggcttgacttagagcgtgaatcaaaagaggcagagttatctgagcagattaagcaagaacttcatcaattattaagcgaaatagagcaagttaaacaagagttaaaataacaatgacagacattatttgggatattaatcttatccaaaaatataatcaatcaggacctcgctatacctcttacccaacagcgttagagtttaatgagtcttataatgatgatgatttcaaagctgctgctgcacgttatcctaataagccactttcactttatgtgcatattccattttgccataaactctgttatttctgtgcttgtaataaaatcattacacgccaccagcataaagtcgatatttatctggattatttagaaaaagagattaaataccgtgcggatttatttaaggatagaacagtaactcaaatccactggggcggtggtacgccaacctatcttgatgaagaacagtcgctacgtctaatggcgatgttacgcaaacattttaacgtaatcgatgatgcggaaatcagtattgaaatggatccgcgagagattgagttggaaatgctcgatcatttgcgtgaaattgggtttaaccgaattagtatggggatccaagatttcaataaagaagttcagaagctggttaatcgtgagcaagatgaagagttcattttttccttaatgaaacgtgcaagagagctaggttttacctcaacgaatattgatttgatctacggtttaccgaaacaaacagtagaaagttttatgtttaccttagaccgtgtgattgagttaaatcctgatcgaatgagcgtgtttaactatgctcatttaccaagtcgttttgcagcacaaatcaaaattaaagatgaaatgttgccagcccctgaaacgaagctcgaaattttacagaaaacgattgaaactttaggtaacgcaggttataaatttatcggtatggatcactttgcaaagcctaatgatgaattggcgattgctcaggcaaaaggggaattacaccgtaatttccaaggctatactacccaagaagatgcggatttgttaggcttaggggtatcggcaattagtttactgggggatagctacgctcaaaaccataaagagctgaaacagtattataccgaggtggaaatgcgtggtattgcattacacaaaggtttgagtatgactaaagatgactgtttacgccgtgatgtgatcaaagccctaatttgtaattttaagctagaatatgaccgctttgagcaagattatcagattgattttaatcagtactttgcagaggatttattattattagcaccgttagaaaaagatggtttgcttgatattggtgcaaagggtattgttgtttcgcctcgagggcgtttattgatcagaaatatctgtatgtgctttgatatttattcaagacaacaagcaaaacgacaacaattttcaagaatcatttaatgataatgtttgcaaataaggcagttacataggcttatttgtttacaaatgtgagtagaatcaaattatgaaaccatatcgctatagtttactttctattgctattgttgcagcttgctgtagtcaatatgtaatagcagatttgagaatgcaatgtttacaaggaattcctacttttcagggggatattatacaaggtgatcagactcttctacctgtgtatattgagtcagatcgtatggaaatgaattatccttctgaggcaacatattttggtgaagttagtgttaagcaaggtaatcgttctcttattacagaaaaagctaaggtagaacagaataacgaacagatgcgttttgcttatttaatcggtaaattcgattatcgggataatttcattaatgcgataggtaataatgcaaagattaatttgaacaactatgatgctcagttaggcagggtcgattaccatttagttgatcgacaaggaagaggtattgctgatgaagtcatgataactgaacaagcccgtcgaatgaaaaatgcaacttttacagcttgtttacctcatgataactcctgggctattgaagctaatgaaatggttcagcatgttgaagaggaatatgctgaagtatggcatgcgcgttttaaagtattgggtatacctattttctattctccttatttgcaatttccaataggggatcgtcgtcgttctggtttattggctccgagtgttggtcattcaagacgagatggttatatatatgcacagccaatatattggaatattgcttctaacatggatatgacatttgtaccaacatactattcaaaacgtggttggcagattgcacctgaactgcgttatttaacttatttaggagaaggtaaaatagccggtgaatatttaggtaaggatcgacttgaaaattgggcaaatcatagtaaatctcgttatatgctattttggcaacatgatatgagtttttttaataattggagattagctgttgattatacaagagttagtgatagtcggtacttttctgattttaattctatgtacgggaatagtactgatggttatgcggtacagcagtttaaattagggtactatcattcagattataatttttctatttcaggaaaaaaatttcagtcattttacgtaaaaaatgatagcactacctatcatgtgttaccaaagattgagcttaattactataaaaataatttagtttctgatgttgatttcaagatgtttgggcagatggcgcattttgttaatcaaaataaactcatgccatcagcatggcgttttcatttagaacctagtttaaatgttccttttgttaaccggttaggaagtttagctttagaaactaagctatataccacctattatttacagaaactggggcaatcacaagtaataccgatagagtcacatatactccgggtattacctcaatttaagttggattttaaaactgtcttggaaaaggaaagacctttgtttaatgggttttcacaagtttttgagccaacaatacaatatttatatcgtccatataaaaatcaaggaaatattggagttagaaatcctaaatatttaggtttaggttatgactccgttttattgcagcaggattattactctttatttaatgagcgtagttatagtgggttggaccgcattgcctctgcgaatcaggttacgttaggcggtactacacgattttttagcgacaaaacaggaaaagaagtatttaactttagtgcaggacagattcaatatttatctccttcaagagttgatagtgagtcgttaaatagcgatacaaaacactcatcttcttggtcattagaatctaactggaaatttcattcaaactggaattggcatggaagttatcaatatgatacacgtctaaacgaaacatcgttagcaaatgtttcattacaatttaagcctaaaaataataacgtgattcagcttaattatcgttatgcaagcaaaaactatatagatcaaaatttaagtgataatcgctatgggcaggatattaagcaagttggaggtattatagcttggtcattgagcaataatttatcaatagtaatgagccactatcaagatattgctttaaaaaaaccggttgagagtcaattgggtttaaattatagcacttgttgttggagtgcaaaattttatacttctagacatttgatttcaactccgatggggaaaagcgatacgataaacgatttctactatgataatcgttttggtattaattttgaagttagatttaatggaaattatgaacataccgtgcctaagatgcttaaaaaaggaattctcccttatattgaagcgtttaatatcaattaaattttttagcctctttgatgaattaaaagaatcaatcaactaagattggttcttatgagtagtggcgaatattgatgaggtaataatgaaaaatccaaagcaatatgcccagcgttatgtcaattgggtattacgtttaggtaaagggaaatccgcattattgggtttgattattttagcggtgtttgcaatttttacacaaagcctattgagctggatatttactgggagcataaatactagcgatatttttcgttctattatttttggtctaacatcggctcctttcgtgatttatttttttaatctaattttagaaaaacttgaacgttctcgtattcgtttggagcaatcgttgaatgatctttccttgttacgtgaacaagatgctcgtttaaatgtagagttagaacaacaggctgaatttttacgttctttcttcgatgcttctccagatcttgttttttatcgtaatcaacatggggagtttctcggatgtaatagggcaatggaagttttaacgggacgttcagaaaaagagttacttcatcttactccaaaagatatttatcctaaagaaaccgctaaattaattctagatacagatagagatactctaattagtaatactggagttacttacgaacagtggattcgccattctaacaataaactttcctgctttgaaattcgtaaggtgccttactatgatagagtaaatgaatgtcactgtattatggggtttggaagagatattactgagcgtaaaagatatcaagaaatgattgaaaaaaatagccgagataagtcaacgttgatggctacaatcagtcatgagttacgaacacctctaaatggtatcattggcttaagccgtattttattagaaggtgaattatctgcacaacaaagagagtatttaaaaacaattaatattagtgctgtatcgttagggcatattttcagtgatattattgatttggaaaaaattgatagtcgccgcattgagttatttcgtagtgaagtagaattctcacaattaatcagtaacatcagccattttgctaatttaatggcagagcagaaaaaaattaaatttacaattcagtacgatgataatttacctgattttgtctgtgtagataatgctagacttagtcaaattttatggaatctagtgaataatgccgtcaaatttaccccttctgggggagagatttcactaaaagtggaacgtcgagatcatgatcattatgcttttattttgaaagattcaggaattggcataaagaaaagtgagcagcgtaaaatttttgcaatgttttatcaatcagaaaattcccagggtaagaaagctcagggaagtggtattggtttagcaatatcgaaacgtatagctcgcttaatgggcggagatttaactgttgagagtgaattaaatcaaggttctgtttttactcttatcattcaagctgatgaagcaaatcattataaagaagtagcaataaatacacatgcgctaaaagtattactggtagaggatattgaagtcaatattgtcgtcgcaaaagctatgttggataagtttgggtgtaatgttgatgttgcaatgacaggagcagaagcatttgagttatttgataaaaatagttatgacttaattttattagatattcagttgcctgatactacgggagtagaaatagcacaaaaattacgtcagaggtatgaggacggagatgttgattatctgcctttattaattgctttgacagcaaatattatgcaaaccaaagctgaatatcagcaacaaggaatggatgatgttttacgtaaaccactatcattagaggctttatctgaatgcttaaatagatattttgatgaagggtttttagaggaatcctcggacgatgtagtcttgttagaaccgataagtaaaatgtcttttgatcctaaaatgcttcaagagttggttgaggtaatgggtaaaaagaatgtgttatcaacattagatctctttaccaacttaatgcctaattatttagagaatttaaatgattatttacaggattggcaagagactggtgatatacagaaacgtaaatgtgttgcggatgaagcgcataaaatcaagggggcattggcatctgtgggcttggttcatttacaacaaattgcgcaattagctcaaagtgataatggaaatgagtgggaaaataatctcgtttcttgggttgaattattgaaagattggagggaagattggaatcaagcggttaggtgggttagcaaaatagataatgtggaaaaattataggaatttctgcttttaatacaaattaatatgtaatatcaagcactggttagatttccattgcaaaaataaatacatattcactattaaatgaattgtttccataaaccggtaattgcgttagaataagactaattagtcttattctatttataaagttaatgaaacctgaaaacaaagcaaattttcaacgtattgtccgtgctacaggctattcaatgaaaggtctgaaaagtgcatatattcacgaagccgcatttcgtcaagaagtgtggctttctttttttctcattcctgtcggtttatatttaggcaatggggcaatcgaaaaaattctattagtcggttcggtgttgcttgtgttagtggctgagctactcaatagtgctgtagagtctgtggtggatcgtatcgggtctgaatatcatgaattatcaggtcgtgcgaaagatattggctctgccgctgtttttgttgcaatgcttatcacagggcttacttggttactgattttatgtttgtaatccagtgagtttttcacttatttctgtcaaaactaaaggatcttatatgaaatttaataaaactctacttgctttggctcttatgggagctactactgcgatggcgtatgaagcggataaaacctataagtttaccgtattacacgttaatgatacccacggtcatttctggaaaaatgataagggtgaatatggatttgctgctcaaaaaaccttgatcgacaaaatccgtaaggaagtggctgaaaaaggcggtgaggttgttttacttcatgcaggtgacttcaatacgggcgtacctgagtctgatatgcaaaatgcaagaccagatattgaaggcttgaatatgcttggttttgatgtggcagtgttgggtaatcacgagtttgacttccctctacaagtgcttgatatgcaagaaaaatgggctaaattcccgttcatttctgcaaacgttatcaacaaaaaaacaaacaaacaccttgtaaaaccttatgttacgcttaataaaggtggcttgaaatttgcggtaatcggtttaactacagaagatacggcaaaacttggtaaccctgatgtgactgaaaatgtggtgtttaatgatccaattaaaaccgcaaaagaaacccttgcccaagtgaagaaaaccgaaaaaccagatgtaagtatcgcgcttacccatatgggctactactttgatgaacaacacggtatgaatgctccaggcgatgtatctcttgctcgtggcttggataatggggcttttgacttgattatcggcggacatactcacgataccgtttgtgttgatgagaaaggcgtatttaaactcaaatatacaccaggtgaagagtgtaaacctgatttccaaaacggtacttggatcgttcaagcaggtgaatggggtaaattcttaggtcgtgctgattttgaatttaaaaatggtaaaacgaagctagtcaaatatgagcttatccctgtcaatcttaaacaaaaaattaagttagctgacggtaagagcgagtataaactgtatcaagaagagatccctgaagataaagctgtatttgagcacttgaaaaaatatcaagatgaaggcgataaattattgggtgtgaaagtcggtgaagtgaaaggtggtatccttgagggtgatcgtaaagttatccgtttccaccaaacgaatttaggtcgcttaattgctcaatcacaaatggaacgtgtgaaagcggatattggtattatgaactctggcggtatccgtgcttcaatcaatgaaggtgaggtcacttacaaaaatctgcttactgttcagccgttcggtaatatgattgcaaccgttgatttaacaggtaaagagttaattgattaccttaatgttgttgccctaaaagaagtcgatatgggagcgtatccacaatttgctggcgtgtctatggttgttgatcgtactgcaaaacaggtgtctgatgtgaaagtcggtggtaaacctcttgatctcaataaaacttacaaagtgtctgtacctgattactgtgcagcaggtggcgatggttatccaatcttgaaaaaacacccaagctatgtgaatacaggctttattgatgctgaaatgttgaaaaaatactttgaagaaaattcaccaattgatgcctcaaaatatgatccaaaagatgatgtgatctttaaataaaaatttacaaaacaatactatgtaataatctgcgacaaagttatttttaactttgtcgcttttttaatgtaataattactgtaaagcaatgcaattaccgtagtgaattatgatgaaaaagcctttgctgacaaagagccgagaaatatcgtagatgtgcttgcaaaaacagatgcttcagtaatgaatttcggtggtgaatccgctaccttacagggggtttatgttcgtggcttacagcttggtgcacgccaatttagtgtaaatggtttagcagggctttattctgcatacaatacaccgacaacagcggttggatctgctcaattaattaaaggtgcttcgacagcaacggttggtatggaccccctgaaggttctgctggtgcatcaatcaacatcgaaacgaagcgtgcaacggacgaagatattaacaaagtcggttttgcttggtttagtaacaatcgcttacaatagtcgttcgatttaggtcgtcgttttggtgcgaataaagagtggggcattcgtgtaagtggcaaataccgtgatggtgatacggctcgtcacgattacgatgagcgagcgaaagaaattgcgattggagcagattatcgtggtgagaaattacgagttggcgtagattatatgcaaagtaagcgtaaaacagacggtggcagagctcgtatccaagatatgcaaaacttaaaatttgcaatgccagttgcgccaaatggaaaaattaatcttaacccagattggcttggacagacgaccgaagataaaaccgcaatggcaacctttgagtatgatctgccttacaatatgatggtttcaggtggctttggacatatgaaatctcgttactcaggtgcatttggacaaattaactcaattaagcaaaatggtgattttagagtatcgggtattcgtggaatggactttgtttctcgtacaacaagcgggaacttaaaattacaaggtgaaactgaaacaggaccgattcttcacaattggagtctagcgtttgattcagtagaacgtcagcgtgaccacgatcaaagcagtaaaactaacggtgcaatttccgcaggatctatttattcaccaaagcgacagagtttatcggcggtacgttagacgtagtgcatggggtgattaatgcggtcgtttccaccattgaatttaccattatcctgtgggggctatcggggatcttggcgatctttggtgtagaaatcccgaaaggtgtggtgttctttatctatatttttattattgttgctaccttactttctgtgattatcggtcgcccactgattgcattgaatttcaataaagagaagctacaaggggattaccgttactctctgatccgtgtgcgagataacgccgaaagtatcgccttttattcgggcgaagccaaagaacaccgaaatttacaggcaaaattttctgcggtattgcgagaagccatttgttatccacatattgaagcaacggacgagcaaattaaacaggcaatggaaaaatgctgtttggataaatatctccacgcacttgatgatgataacgactggcaacttaccctttccccaggtgaattgcaacgggttgcctttgtgcgaattttactcagtaagccagcgttgattttccttgatgaaacaacttccgcccttgatgaaccgacggagtctattctttaccgtaccattcggaaagtgctgccaaacagcaccattatcagtgtcggacaccgttgcaccttgtacccttatcataacaagcggattaatattactgcgggttgttgtggggtggaagagtgttgtatgaataggtagaaaacagaggggagagccttgtttcagtacgatgataaagttatttaggctgttcttacctctcactctgactttgtttctgccaaatctcccccagcccctctttgctaaagagggggatttgttcatctgtaaatttaaagattgaagatctcccaaaatgatgtttaattctgtagatacactagaattttcatctaaaccagttcccctctttagcaaagagggggtaggggagatttggcagaatagacaacgaagtgaggaaataatgatatagaaggtaaataaaagcagatttaggtttatcatcaacttgaccattataaatttctcacaaattccgaaataacaggcgatttttcagaaaatctctgtataatagccaagttttatttcttcgcattctaagaggcggctatcaaaagtaatttgatgtgtgagattacttttgctagtcgcaatttttaggaaataaaacaacaacaaatccaaaaattcataaggaacattcaaatgactccaatcgttaaacaatttaaatacggtcagcataccgtaactttagaaacaggggctattgctcgtcaagcaacagcagcagtaatggcaagtatggacgatacgacggtttttgttaccgttgtggcaaaaaaagaggtgaatgaaggccaagacttcttcccattaactgtagattatcaagagcgtacttacgcagcaggccgcattccaggtggtttcttcaaacgtgaaggtcgtccatctgagggtgaaactttaattgctcgtttaatcgaccgcccagttcgcccacttttccctgaaggtttcttcaacgaaattcaagtgattgcaacggtggtttctgtcaatccacaaatcagcccggatttagtggcgatgatcggtgcttcagctgcattatctttatccggcgtgcctttcaacggcccaatcggtgcagcacgtgttggttttattgataaccaattcgtcctaaacccaactacatcagaacagcgtttaagccgtttagatttagtggtagctggtacagacaaagcggtattaatggttgaatctgaagcagatatcttaactgaagaacagatgttagccgcagtggtgtttggtcacgaacagcaacaagtggtgattgaaaacatcaaagaatttgtgaaagaagcgggcaaaccacgttgggattgggttgctccagagccaaatacagatttaatcaataaagttaaagcattagcagaagctcgtctgggcgatgcttaccgtattactgaaaaacaagcacgttatgaacaaattgacgcaatcaaagctgatgctatcgctcaattaaccgcagaagatgaaaccatttcaagcggcaagattgtagatattattaccgcattagaaagccaaatcgtgcgtagccgtattatcgcaggcgaaccgcgtattgacggtcgtacagtggataccgtgcgtgcattagatatttgcactggcgttttaccacgtactcacggttcagcattgtttacccgtggtgaaacacaggcgttagcagttgcgacattaggtacagagcgtgatgcacaaatcattgacgaattaacaggcgaaaaatcagatcgcttcttattccactacaacttccctccatattcagtaggtgaaacaggtcgtatcggttcgccgaaacgtcgtgaaatcggtcacggtcgtttagcgaaacgtggtgtgttagcagtaatgccaacggcagaagaattcccttatgttgtgcgtgtggtatctgaaattaccgagtcaaacggttcttcatcaatggcttctgtatgtggtgcttctcttgcgttaatggacgctggtgtgccaattaaagcagctgttgcaggtatcgcaatgggcttagtgaaagaagaagagaaatttgtggtactttcagacattttaggtgatgaagaccacttaggcgatatggactttaaagtagcgggtacccgtgaaggtgtaactgcattacaaatggacatcaaaattgaagggatcacccctgaaattatgcgtatcgcattaaatcaagcgaaaggtgcgcgtatgcacattttaggcgtaatggaacaagcgatccctgcaccacgttcagaaatttctgacttcgcacctcgtattcatacaatgaagatcgatccgaagaaaatcaaagatgtgatcggtaaaggtggtgcgacaattcgtgcattaaccgaagaaactggcacatcaatcgacattgatgatgacggaacagtgaaaattgcggcaacagacaacaacgccgcgaaacgtgtgatggaacgtatcgaagagatcgttgcagaagttgaagtcaatgcgatctacaaaggtaaagtaacccgtgtagtagatttcggtgcattcgtgtctatccttggtggtaaagaaggtttagtgcatatttctcaaatcactgacgctcgtgtagaacgtgttgcggattacctatctgttggtcaagacgttcaggtgaaagtggtagaaatcgagcgtcaaggccgtatccgcttaacaatgaaagatctgaatggtgatgcaactgctagggaagttgttgaagaaattcaagaattagcagaataatcacttctgtcccttcctcacattgaggaagggatcttcattttaagaatgataaatacctaaggttttattaatgccacaacgttttaagttgtttaatcttcgtttttgctggttagttttggtaatgatttttttgacaggctgtgtgaacagagtgtcagatatgattgccccgacaaaattacctctctcggaactcaatcctcagttgcgttttgaacaggaagtaatgcttgttcgtttaacgcaagtgttgcaagaagcgaaattaagccaagctgaacgtgccgaattacattttgaaagaggcgttatttacgacagtttaggactttggtcgttggctcgttatgattttacgcaagcggttgaatatgcccctaaaatggcagctgcctataattatttaggtttatatttgttgcttgaagatgattatgacagctctatagatgcttttaatgccgtgttagaactcgatccaaattatgactatacccgtttaaatcgtggtttagcattttattatagcggtcgttattctgaggcagaacgtgatttattgcgtttctataaagcagataggtccgatccttaccgtgtattatggttatatttcaatgagttagaattaaacccaagtgatgcaaaagcaaatttgttaaaacgtgccaagcatttgtcaaaagacttttgggggacacatttagtgtcttacttgctaggggattttactcttgaacaacttcgtttaaaaatgattgctcaagctgaaccgaatacggtagcttatgcagaaattttaaccgaaacatatttttatcttgcaaaacaaacactcaaaatgaatcagcttgaagaggctaaaagccttttccgtctagctagtgcaaatcaagtatataactttgttgagtatcgttttgcgttgtttgaattagctcaattacatcaaagagcgaaacaaacagatcccgttgttgttgggaaaaattaggacgatttaagcggtaggtttcgcaaaattttttgcaaatcaaaccgcttacactgtatgacaagttatataaagcattggtttactttctatttatttttcttacctaaaagctcaacaatgtagtttttatctcctgtgtaatacttccccctttgaaaaagggggattgagggggatttttagatttaatttttcatttgcgtgaattaaatcccccctaactcccctttttcaaaggggggaacaggttctttatttttggaattttatgactgaaacaactttaactttcgccgatttaggcttaccacaatctatccttaacgctgtaaatgaaatgggttttgtaaccccatcaccgatccagcaagcctgtattccacaccttttaaatggtcgtgatgtgttaggtatggcacaaacaggaagtggtaaaacagcggcattctctttgcctattttggctcaaattgatccagaacagcgtcacccacaaatgttggtgatggcgccaacccgtgaattagcaatccaagtggcagatgcttgtgagcagttcagcaaaaatatgaaaggtattcgcacggtcacgatttatggtggtcagcgttatgatattcaaatccgtgctttaaaaaatggtgcgcaagttgtggtaggaacgccagggcgtattcttgaccatattcgccgtggcaccttagatctttctatgttgaaagcgattgtattagatgaagcagacgaaatgttgcgtatgggctttatcgaagacgttgaaacggttatggcggaattacctgaagatcaccaaacggcacttttctctgccacaatgccagagccaattcgccgtattaccaagcgttttatgaaagatccgcaagaggttaaaattcaggcaacccaacgttctgcaccagatattgcgcaaagctactggttagtgaacggcttccgtaaaaatgatgcgttattgcgtttcttagaagtagaagagtttgatgcggcgattatttttactcgtaccaaaacgggcaccattgatattgctgaactctgtgagcgtaatggctatcgtgcagccgcattaaacggtgatatgacccaacaagcgcgtgaacaagcattggaaaaactaaaatcaggtcgtttagatgtgattgtggcaacggacgtggcggctcgtggtatcgacattgagcgtatcagtttggtagtaaactacgacattccacttgacgcagaatcttatgttcaccgtatcggtcgtacaggtcgtgctggtcgttcaggtcgtgcattattatttgtagagccgcgtgaacgtcgtttattgaaaaacattgaacacttaatcaaaaagccgattgatgaagtgccagtaccaaatcacgaaattttaatggaaaaacgtcgtgagaaatttaaagcacgcatttcattacaattagaacatcacgatttagagctttatcgtgaattattagaagatctattcacggcagaccaagatcacgaagaattagctgcagcaatgatgatgttgttgcaagaaaaacaaaaacttattcttccgccagatcctgaaattcgcccttctcgtgctgagcgtggcaaaggacgtgaaaatccacgttctgcggaacgtcgtggtggcggtcgtgagcatcgtgataacaacggcgttgcgatggatctctatcgtatcgaacttggtcgtgaagatggtgttgaagtgcgtcacattgttggagcgattgccaacgagggtgatattaacagccgttatatcggacatatcaagttacacgataaatactcaaccattgaattaccacagggtatgccgaaacatttagtgcaacatttcgcacagaaagcacgagtgttaagcaaaccaatgcaaatgtctttcttaggtcctgtgggcagtacaactaatgctaactcttatgaagataaaggcggacgtggtaaaggtcgtggagaccgtcacgaacgaggtggcagagagggtcgccgtgaagaacgtggctttaaagaccgcaaagaaggtggatttaaagaaaaacgttttaacgagcgtggtcgtcgataatctgatgcgtagggacacactgcgtgtgtccgctacttgtacctaaattgtgatttatggacacacgcagtgtgtccctaccattttaattaaattatgtttatccaacccacccaatcccattgcgatttaaccttaaccgaacaggatgtttactttatgcaatacgccttatcccttgcagataaagccgaagcagaaggggaaattcccgttggggcagtgttggtcgataaaacaggcaatattatcggagaggggtggaaccgtgcaattattctctctgatccaaccgctcacgcagaaattcaggcaatccgaatggcaggacagcaattacaaaactatcgcctattagatacaatcctttatgtgaccctagagccttgtacaatgtgtgctggagctattttacatagccgtattggacgtttagtttttggagcatcggattacaaaacaggggcgctaggctctcgctttcatctttttgaagactataaaatgaaccattttctgcaaattcgaggtggcgtgatggctgatgagtgtagccaaaaaatcagtgctttttttagaaagagaagggaagagcagaaaaatcagtatgttaactacaactcatcaaaatagctctgtccccacgtcttttcagctaattgcaacaaattcgcaaaatcttgataagaaggaaacgcttggtcagcgatattatgttgctcactgatcaacttttgacgaagttcttcataccattgcaacaaccccaagggtagcggcgatttcgcccgtcgcccaagccaaaataacccttgaaatggaatactcaatgcaaacaacgccgttaaggtcgcattggctagaatggattgttcaggatcgtggaaaaagtattgccaaactaacgcaaaacaagcaaaagcaggcataaaatgtgacgaaaatttaactaagcggattaaacgataatcgggcataaacagtccgagtttcttctgatttgggaaggtattgaggtaacgctgtcctgcttgcaaggtgtgatacataatttgcctttatcgttaaataattcaagttacattctactcatctctacaaaatctacaatagcgaattatcacaacagttgctatactttccatatagttacgcagaatgatgtagcaaatgctataccatactgtattatgttgaattttcaccacattaatttaaggaagtcaaatgccgattaaatttccaagtttgttacaagatagttggaattttatccgtaatcaagggagctttacgcttacgggtaccgcattattaattttattacaattatccaccatttttctctttcctagagtagaaatacaggcaggaaatacatcaaatcaagagatgttaactttacttacatcacaacttgccccaaccattatttctgctttgattagtgtatttatcaatatcttattgattttaaacattaaagctatcaacagtggcacttatcaacatttcagccaaaatatcggggcaactctcaaagcctttttcccggtgattttactgacgatttttatggtaatgccactttcaatcgggatctcatttggtggcaccgtcgggcaacaaggcagtcttgccataatgatcttaccgctgatggcaacgggtatctatctgtttgtcaaacttagcctcgtcgtctatgcctatttacttgaagctccacaaggcattatgcaaaccctacgttttacttggggattaagtcgaggtagaatgtttccgcttttcctattttgtatcttaagttatttcttccctagcttgctaggttcattaatcggtagaattggcggagatgtcgggattattctttcacaagtggtcggagcctttatcagcttatttgttgttgtatttggtttccgtttctatcaagtgtatcgccaataggattgacaatgaaacaattacttgaatttattccactgatcctcttttttgtcgtctataaaacctatggcgtacaagaagcagcattagtgctagttgccgctaccgtggttcaatttatcgctttacagttgctttataaaaaaatcgaaaaaaatcaatggattatgggaatagcggtcgttttcttcggtttacttaccgcttactttaacgacctggcattccttaaatggaaagtcaccattgtcaatgccatttttgcggtagcgttactcgttagccaatacgtattcaaaaagcctcttatccaaatgttacttggcaaagaactcaaactgccacaaaacgtatgggaaaagctcaatttaggttgggcaggctttttcatcttctgtatgatcatcaacatcatcatcagtgagttcttctctgacgatgtttgggcaaatttcaaggtgttcggtttaacaggattaagcctcattgtcgttatcggcacaggcttatatctctacccccacctaaaacaactagaacaaaaagaggaaaataatggaaacacaaactaaacgccagcctgaaggcacattaattttacgcaccctcgcaatgccatcagacaccaacgccaacggcgatatttttggtggttggataatgtcacaaatggatatgggcggtgcgattttagcaaaagagctagttaaaggcagagtagtgactgtttcagtagataaaatgtcgttcttactgcctgtatcagtcggtgatgtggtttgctgttacggcaaatgcaccaaagtcggacgcacctcacttcaaatcaaagtcgaagtatggatcaaaaaagtgtatgaaggaatgagagaacgccactgtgtcaccgaagcactctttacctttgttgctgtggatagcaacggcaaacctcgtgttatcccacgagaaaacaacccagatcttgaccaagccttagctttaattgaaccttaatggaggacattatgtactatgtaatttttgctcaagacataccaaacacccttgaaaaacgtttagccgtgcgtgaaaaacacctcgaacgcctaaaacaacttcaagccgaatatcgccttttaaccgcaggtccaaacccagcgattgatgatgaaaacccaggtgaagcaggttttacaggctcaaccgttattgcaaaattcaattcacttgaagaagcaaaacagtgggcaagccaagatccttatgtggaagcaggggtgtatggcgaagtgattgtgaagccgtttaaaaaggtgttttagtttaattaatatagattcaattcagataagaaaccaagtaatgttattatttgggtgcttatctaattgagagatagtcgataaacagttgctacggcacatcaaaatgatgcaggtttccgttgagagtaaaattagcctgccatcatctggctacaaaactcaacttattcatttgcccctatcccctgataccaaggactaaagcggtttcttgcggtggaaatgttgtaattatctgaataaaaatcgacttggatcattcccacttgagcagtattaagccacttcacctgatactgctcaagccgttgaataacttgactatttggcattttccacgggttccaacgcccagccgaaataatcgcccaagtgggttgtgtgtgagctaacaaggtttggctggtactggttttactgccgtggtgtcctacttgaagaaaatcgatcttaccgatctggcttgcatattgtcgttcttccgcaatcccactatccccagtaagaagcaatctatatttccctatcgacactcgtaatacacaagagtgttcatttttagctcgctcgctcagttgcaaaggataaatcgcttcaaggtgtattgtgctgaactgccactgattgcctcctatacaaggctcggcgacttggttactataatgatttttacccgaaaggatcaaccgtgcatttgggtaggcttgtagtaatggcaaaacgcccccagcgtgatcgttatcatcgtggctaacaaaaatagcttcgactactatcccttcacggcgtaaatagggcagtatttccaattccgccattgtgccaccttgccacgcaacgcctgtatcatagagaatagctttctgtttaccttggtgttgataaatcaatcccattgccaacccttgccccacatcgaaattcacccattttacaagcggtggtttaagtgtatcttttacaaaatgaaatccgatccacaatgctaaaggcaatgccactgttgctaacccataatagagagaaaaacgttgctgaaaaacaccatataatcctattaaaatcaataaattaaggcatattaatccccattgttgatcgacacttaaatagagccaatgatgggaaaatggctcaatccaatcaatcccccactctgcaagttgatggcaaagccaccaagtttgaaataggttatctgttaataaactaaataaaatcaatgggataagaataaaactataaagtggaacaatgatcaaattggctaataaagcgaaaggtgatgtgccatcaaaaaaactgagttgaataggcgagaacactagccaaatgcctaactgcagatgaaacaactctaacagcaatttcatcactcgattttgcatatttttgacaaaatcaaaccgcttgagtggaaaagcctgataccaaataattaggctagcaacagccaaaacagagagccaaaagctatcagacagtaacgtcagcggatcaaagacgactaatagtaccacaccacgaagccataactgccaaggcgtataatgacgacgagcatattgcaccagcaaaaccaatgaaatcgccaccattgcccgtaccgttggaatttggaagcctgccaaaaaactatatcccagcgccacacaccaccctactccccttgcaaaatacaaggacaaccccaccgctttcagataacgaaatcgcaataataaccactgcccagctttcaccgcccaaaaggctaacagataaaccagaacaatatgcgagcctgaaatggcaatcaaatgagcagtggttgtttgctgaaagatctcccaatggctttgacttaaccaagcccgttcaccaaaagcaagggcaagcagtaacccttgcgttgcaaaaggggcggtctgttctcgcatacgatcaagccaaattgcacgcaagccttgttgttcgttcacttttactgcttttttgaccgtagctgttgctgagatatgttgagccacataccatttttgtcgatcaaaattgccatcatttaagcgagcggacaaaggcttcaataccagttccgcgttataacttgcttccagtatcaatggctcatctgcttgccaattgacataaacatagtccccattagcacgctctacaacggcagtttgatattcttgctgttttaaaatttgcttcactaacacccgctcttgcaccttaacagcggtctgttcctgatgtttttttgcaagttgtataatctgggcgtaactcaccgctaacacaccacccaacagcaagatccccaatttcccacgccatactccccataatgcaagggcaagagaaaataccatcacatagccaagccacgaagcaggcagaacaatcaacggcaataaaccgaaaaagagcattaaacagacacgatcaatagacatcatcaacatacctaatcaaagagattacagtatgccaatgatgaaaagagagaaaagtagaaaaataatgtttttcgacagggatcacaaaaataaatattggtatatcaaattgtttgtagttatgatttttaacacgatatctttttaatttagattaaaaagttagataagaaatgcaaataacttgacaaatttttcaaagaattttcaaaattgagaagtagttcaaattttaactacaaggagtgtggtagtattagctcgaaagctgagatggctcagttattactaaacacaacaaggagtatattatgtataaacatattttagttgccgtagatctctctgaagaaagccttgtattattgcgtaaaggtgcgagtcttgctgaaaaatgtaatgcaaaattatccgttatccacgttgatgtgaacttttcggatctctacactgggttgattgatattaatatgtcgtctgttcaagattctgtgtcagaagaaacgatcaaagcattagaggaactctctggtaaaattacttaccctgttactgaacgtttaaatggtagtggtgattttagtcaagtgctggaagaagcggtagaggagtatcaagtggacttattggtcactggtcatcaccaggatttttggagcaaatttatgtcttctactcgtcaagtgatgaacagtgtaacggtagatatgctcgttgttcctttagcaagtgaataactcaagctattgattggtaaataaaacgtgaaaaaagaccgcttgtgtagctgagttatcgcattcagttactctggcggtctattttttgacttaatgtcaataatttatgcagtaaaaaatacaagtattgaaaaaaatgtgtaaaataggtgggtgaattactaatatactttagtaaaaacatagatatacagttttttatatccatttgagtgactttaatgaaaacaacttcagagattagacaagcctttttggagtttttccaaagcaaagggcatacgattgtgccaagtagctcgcttgtacctgaaaatgatccaaccttgcttttcacgaatgcaggaatgaaccagtttaaagatgtgttcttaggattagacaagcgtagttataacagagcaaccagctctcaacgctgtgtgcgtgctggcggtaagcataatgaccttgagaatgtaggttataccgctcgtcaccataccttttttgagatgttaggtaactttagttttggtgattattttaaacccgatgcgattgcatttgcgtgggaatttttaacatcaccgcagtggttagcgttaccaaaagagaaattgtgggtgacagtctatgaaacagacgatgaagcctatgatatttggaatagagagattggtgtgcctgctgagcgtattgtgcgtattggtgataataaaggcgcgccttatgcgtcagataacttctggcaaatgggtgatacgggtccttgtggtccttgtactgagatcttctacgatcacggtgaccatatttggggaggtccaccaggctcaacagaagaagatggcgaccgtttcattgaagtatggaacgtggtctttatgcagtttaatcgtcaagcagatggtactttaaagaaattacctaagccgtcggtagatacgggtatgggtttagagcgtatcagtgcggtgttgcaacacgttaattcaaactacgaaatcgacattttccaagcgttaatcaaagagattgcttctttgttaaatgtgacagatttagacaataaatcgttacgcgtaattgcagatcatattcgttcttgtgcgtatttgatcgctgatggtgtgatgccgtcaaatgaaggtcgtggttatgtgttgcgtcgtattattcgtcgtgcggtgcgtcacggaaacattcttggtgcgaaatcagcgttcttctatcaattagtgccaacccttgcaaaagcaatggggcaggctggtgagattttgacgcagaaacaagcgcatattcagaaagcgttaaaagcagaagaagatcagtttgcgcgtacccttgagcgtggtttagcgttattagaagatgcgttaaccaaagtagagaataaggttttatcaggtgaagtggcatttaaactttacgatacttatggtttcccactggatttaacggcagatgtttgccgtgaacgtggtattaccattgatgaagctggctttgagcgtgaaatgcaagctcaacgtgcaagagcgcaggcaagcagtaattttggtacagattacaataatgtgattaaagttaatggctcaacggagttcaacggctatgaggtcacagaatgtgaagcgactgtcgttgcgttatttagcaatggtaagacggttgaagctattcaatcgggggaaaatgcagtcgttgtcttggatcgtaccgctttctatggagagtcgggcggtcaggttggtgatagcggtgtgattgcttcagaaatttgcaattttgaagtcaatgatacgcaaaaatatggtcaagtctttgggcatattggtcaattagcttcaggcactttatcagtcggagataaggtgaaagcagaagtgaatacgacacgtcgtcacgctattaccttaaaccatagtgcaactcacttgttacattcggtacttcgtcaagtgttgggtgatcacgttgtacaaaaaggttctcttgtgtcagaaaattcacttcgttttgacttttctcaaggtgaagcgatttcaaaagctgacttagaagagattgagcgtattattaatacgaaaattcgtgaaaacattgtagttacaactgaagtaatggatcttgaatcagcgaagcaaaaaggtgcgatggcacttttcggtgagaaatatggagatagagttcgcgttgtagatataacagcagcgttttctgtagaactttgtggtggtactcacgttaaacaaacaggtgagattggcttattcaaagtggtatctgaaggtgcggttgccgcaggtgttcgccgtattgaagcggtgacaggcgaaaatgcaatcggcttattacatcagcaacaacaaattcttaaccaaagtgctgagttattaaaagcagatacggcaagccttgttgagaaaatccagcagctacaagagaaaagcaagaaagtagaaaaagagctacaacagctcaaagataaacttgcagctcaagctggtggagaattagcaaaacaagctaaacaaatcaacggggttaatgtggttgttcaacgtttagaaaacgttgatgcaaaagcattaagaacgatggtcgatgacttgaaaaatcaactaggttcagcggtgattgtctttgcaacacaaactgatgaaaaagttaatttgatcgtaggtgtaacaaaagatcttacagacaaagtaaatgcaggcgagcttgttgggttaatggctcaagaagttggcggtaaaggcggtggtagagctgatatggcaatggcaggcggtagccaaccagaaaatataacccaagccctcaatgttgcgacgaattggattcaagcaaaactctaattataaggggcaagttagaatgactttggcttgccctgattaaatctaaaaggagagatagttatgcttattctaacccgtaagattggcgaaagtttattgatcggtgatgatgtagaaattactgtcctaagtattcgtggtagtcaggttaaattaggggtgaaagcacctaaggaaatttcggttcaccgtgaagaaatttatcaaagaatcaaagcgttagcagatgaaaatccttcagaataaggtatattgatatttactgaagttcttgatctaacgtaatgtgaatttgatccttgaaccaaatgttacaaacagataaattgaaacgcagtgttcaattttttgaaaaaatttgtgcaaaacggaccgcttacttaaggtaggcggtttactttatctaaatatattaaggatttttctatgaaagtgattattcctgtcgcaggtcttggtactcgtatgcttcctgcaaccaaagcaatcccaaaagaaatgctaaccattgcagacaaaccgttgattcaatatattgtaaatgagtgtgtggctgcaggagtaagagaaattgtgcttgtcactcattcatctaaaaatgctatcgaaaaccactttgatacatcgtttgaactcgaaacaatgttagaaaaacgagtgaaacgtcagctattagatgaagtgcgttcgattgtacctaaagatgtgaccttgatgcacgttcgtcaggggcaagcgaaaggattagggcacgcggtattatgtggtcgagctgtggtaggaaatgagtcttttgcagtggtattgcctgatgtgttattggcagattttactgcagatcaaaaaacagaaaacttagcagcaatgattcaacgtttcaaagaaacaggcaaaagccaaattatggttgcacctgtggcgaaagaaaatgtgagtaactatggtattgtagattgccaaggtgcagaattacaacctgcaggtacagcgaagattgctaacattattgaaaaaccaagtattgaagaagctccgtctaattttgccgttgtgggacgttatgtcttctctgcagaaatttgggatttacttgccaaaacaccggtcggtgtgggtgatgaaattcaattaaccgatgcgattgatatgttgattgaacaacaagaggtggaagcctttcatatgacaggtaaaaccttcgactgtggtgacaaattaggctatatggaagcctttgtagaatacagtttgaaccacgataaatttggtggtgaatttaaagattatttgaaaaaattatcgaagtcgctgtaattaaatttatataaaatgtagggacacactgcgtgtgtccctacgctaacatggagcaaatgtgatcgttaaaaaaatagcacaagcggtaggttttgggcttttttgtgctggcttgattctttatgttgccccttgcttaaacaaaagcactcaaacagagattatcagctttcacgatgcggtaagaattgcgtcgcctgcggtagtcaatgtttataatcaggcctttgattctacccattcttatacaggggagttacaagtaaacaatttgggatcgggcgtgattatgacctcaacgggttatattttaacgaataaacacgttatccaaaatgcagatcaaattttagtggcactgcaatcggggacgatttcgagtgctacattggtaggatctgacaccttaactgatcttgctgttctcaaaattcaagcagaaaacttgcctacaattcctcaaaattcaaaacgcgtggctaaaatcggtgatgtggttttagcaattggcaatccgttaaatttagggcagagtattacgcaaggcattattagtgcaacggggcgcaatgcattatctgaaatgggtcggcaaaactttattcaaactgacgtttctattaataagggtaattcaggcggagctttggtaaatacggctggtgagttgattggcattaacactttaagtttaggaaaaaacagtgatgaattggcagaaggattgaattttgcgattccgatttccttagcaaataaggtgatggaaaaaattattcgtgacgggcgtgttattcgaggctattttggtgttaatagctcgttgtactatacggctaaacagctaggagtcggtgaaaaagggatcttaattactacagtagctgaaggtggacctgcggataaagcagggattttagctggtgatttgattttacgtttaaatgatacagaagcccaaactccagctcaaatgatggaattgattgcagaaatgaaaccaaatagtaaggtaaaggtattaatttctcgtcaaggcatacagaaagaagttgaagtggttattggtgaatttccagagttataaaggataaatatgggtattgtaattacagttgatgggccaagtggtgcaggaaaaggaaccttgtgtcacgcccttgcagagaaattaggctttgattttttagattcaggagcaatttaccgtattttagcattggctgcagtaaaacaggggattgcctttgagaatgaaacggctcttgcgcagcttgggcgaaatcttaatgtgaaatttgtgcctgagaataatgaaattcaggtcattttggacggtgaaaacgttggcgatcaaattcgtacggcacaagcgggtcaaaatgcgtcaaaaattgcggtttatcctcaagtgcgtgaggctttgttacaacgtcagagagattttagaagtcctaaaggattaattgccgatgggcgagatatggggactgtcgtctttccagaagctgaaattaagttctttttagatgcaagtgcagaagaacgcacaaaaagacgtgtaaaacagttgcaagaaaagggatttaatgctaactttgacgagattttagccgagataaaagagcgtgattttcgggacagaaatcgccctgttgcacctcttgttccagctaaagatgcgatgattttagattcaacgcatttatccattgaggaagttattcaacaagcattggattatattgctcaaaaattgtaattttgtttgcttaacaaaggattgttaagtcgttatccctaaccccatttagatggatgctaaatggacgttttattttatttaagaagattaattatgactgaatcttttgctcaactatttgaagaatcactaaaaggtcaagaaacccgtttaggttctattgttaaaggtactgtagttgcaattcaaaaaggctatgtacttgtagatgctggtttaaaatcagaatcagcgatccctgctgaagagtttttcaacgcacaaggtgaattagaagttcaagttggtgatgttgttgatgttgctcttgatgcagtagaagacggtttcggtgagaccaaactttctcgtgaaaaagcgaaacgtaacgagtcttgggctgcgttagagaaagccttcgaagaacaagcaaccgttgttggttttgtaaacggtaaagtaaaaggtggcttcactgttgagttaaacggtgttcgtgcattcttaccaggttcattagttgatacccgtccagttcgtgattctttaaatcttgaaggtcaaactttagaacttaaagtaatcaaattagaccaaaaacgtaacaacgttgtggtatctcgtcgtgcagtaatcgaaacaacaagctctgctgatcgtgaagaagtattagcgaacttagttgaaggttctgaagtgaaaggtactgtgaagaacttaactgactacggtgcattcgtagatttaggcggtgttgatggcttattacacatcacagatatggcgtggaaacgtgttaaacacccaagtgaagttgttgcagtgggtcaagaagttactgttaaagtacttaaattcgacaaagagaaaacgcgtgtatcattaggcttaaaacaattaggtcaagatccgtgggcagctattgcacaaaaccacccagtaaacagcaaattatctggtaaagtaactaacttaacagactacggctgtttcgttgagattttagacggcgttgaaggtttagttcacgtttcagaaatggactggacaaacaaaaacattcacccatctaaagtggtaaacgtaggtgatgtggttgaagtaatggtacttgaagttgatgaagaacgtcgtcgtatctcattaggtttaaaacaatgcaaacctaatccgtgggaatacttcgctgaaactcacaacaaaaacgataaagtaaaaggtaaaatcaaatcaatcactgatttcggtatctttatcggtttagaaggtggcattgacggtttagttcatttatctgacatttcttggaatatggctggcgaagaagctgttcgtaactacaaaaaaggtgacgaagtagaagctgttgtattacaagttgatgcagtgaaagagcgtatctctttaggtatcaaacaattagaatctgatccattcacaaacttcgttgaaggcactaaaaaaggtgcaatcgtgaaaggtaaagcggttgaagttgatactaaaggcgttaaaattgaattagcagacggtgtagaaggttatgttcgtgcagctgaagcaacccgtgatcgtgtagaagacatcacaacagttatctctgtaggtgacgaaatcgatgcgaaatacacaggtgttgatcgtaaagctcgcattgtaaacctttctattcgtgcgaaagacgaagctgaagaatcagcagcacttgcacaagtgaataagcaagaagaggctattccaagtgcaatggctgaagcattcaaagcagcaaaaggcgagtaatttactctcttcgtaagcggatatgtgaaagcatatccgcttcacctatcgcataaggagaaaatatgactaaatcggaattaatagcaaatctcgtagctcaatatccctctctatcagttaaatctgttgatgaaagtgtaaaagaaattttagaacagattatggggtcgttagaacaaggtgaacgcattgaagtaagaggctttggcagtttttctctacattatcgtcagcctcgtgttggacgtaatcccaaaacaggcgaaagcgttaagttagatgctaagtatgttccgcacttcaaagcaggtaaagaactgaaagaacgtgttgatttagcttaattctctgaaagcgacactatgtggggtgtcgtttttttataaactaatgtaataatggagatacgcagatgaaatatattttgggcatcattattgtgcttgctatcattcttgttgccgtgactattggggcaaataacgatcagcttattacattcaactacatcatcgcaaaaagcgaattacgtttatctagccttgttgccattttgtttggatttggtttaattttaggttggttaatcacgggatttttctatttaaaagtgaaattacaaaatattgccttaaatcgccgtgtaaaacgccaatctcaacaaattagcgaacttactttaccaaaggctgaataatgcttgaattgttgttccttttgttgcctattgcagccttgtatggctggtatatggggcaacgtagtgcaaaaaaggatcaagatgcaattaataacaaattttcccgtgactatgtcacgggtttgaactttcttttatctaatcagcaggaaaaggcggttgatcttttcctttctatgctacaaaagcaggagtctgagaaccagatttcaacagaatcacaatttgaagccgaaattactctaggcaatttattccgatcaagaggggaggttgatagagctttgcggattcatcaagggattgaaaacagtcttcactattcctttgaacaaaaattactagcaaaacaacaacttgccaaagattttatggctgcaggtttttatgatcgggcagaaaattactatattaccttgcttgatgaacctgagtttgcagtcaattcattaagtcagcttgctgtgatttatcacaaaacacgagaatggaaaaaagcgattaatgtcgctgaaaaaaggcttagaatagagcctgaaatggataagatccctttatctcactattattgtgaatatgcacaagcggtcagatcggacgatgaaaaagcatttttaacagcattacaaaaagccctttcttacgttcctcactgtgcaagagcctcaatactcttcggggattttttctttgaaaaacaagaaatgcgaacggcattacgctattttgaagcggtattagaacaagaaccgaactacatcagcgaagttttacataaaattaagcaatgttatattgcgttaaatgaacaaaataattttgagctgttcttaatcaaagccaaccaaattaaacacaacagcagtattgatttggcgttagctgaatttattgaacaaaaagatggcgtagaagccgcacaatcacggctttatcaacaagttagacaattcccaagtttaatgactttccatcgttttatttactatcaagtaaatgaagcggaggagggcagaggcaaagagagtttagttctattacataaaatggtcggtgatcgaattaaacagggatttcaatatcgctgtattcattgcggttatcaaagttaccgcttgtcttggcactgcccatcttgtcgaacttgggaaagcattaaaccgatgcaaagtattacagaagtgatttaacataggagaatttaaatggacaacaaaattatcgtcgcccttgactatgaaacagaagccgaagccctcaatttcgttgatcaagtcgatccgtccctttgtcgtttaaaagttggcaaagagatgtttaccacattgggtacacattttgtgaaacagttacaagaccgcaaatttgatgtctttttagatttaaaatatcacgatattcctaacaccgtcgcaagagcggtgcgttcagcggcagatttgggggtgtggatggtggatttacacgcctgcggcggtttacgaatgatggaaaccgcaaaacaaattttagagccttacggcaaagatgcaccattattgattggtgtgactgtgctaaccagtatggaagatttagatttattgcaaatcgggattaatgcgtcaccgatggaacaagttattcgtcttgcccatttgtgccaacgtgcagggttagatggtgttgtttgctctccacaagaagttgaggtattaagaactcactgtggcaaagattttaaactcgtcacgccaggtattcgtcctgaagggagtgattttggcgatcagcgtcgtgtgatgaccccaaaacaagcgattgaaataggatcagactatttggtgatcggccgtcctattacccaagcggccgatcctcttgcagtattaaaatcaattaatcaatctatcgcctaataagcggttcatttagaaggaaattttacaaatgactttagtgtattccacagaagtaggtcgaattacaccagaaaaaccgaaggctgaacgcccgaaaggtgatggcattgtgcgtattcaacgccagacaagcggtcgcaaagggaagggcgtttgcgtaattacaggtgttgatttagatgatcgtggtttagtggcactagcttctgaacttaaacgcaaaacaggctgtggtggttcagttaaagatggtgtgattgaaatccaaggagataatcgagatcagcttaagctaatgttggagcagaagggatataaagttaaatgacaatgctgaattcagaaatattacgatataatcgtcagattatattgaaaagcattgattttgatgggcaagaaaagttaaaagcaagccgagccttaattgttggattgggtggattaggttgtacagcgagccagtatttagcaagcagtggtattggatatttaaccttagttgattttgatacggtttcactttctaatttacaacgacaggtactacattctgatgcaactatcggcatgccaaaagtagaatcggctaaaaagcgtttacatgaactgaatccccatattcaaatcgaaaccattaatgcgtatttagaagaagatgaatgggctaaattgattccccaatttgatgtagttttggattgtacagacaatatgacaatccgtaatacactcaataaaatttgttttaatgtaaagaaaccgcttgtatcaggctcagctattcgttttgaagggcaagtgagtgtttttctttaccaaaaacaagatccctgttatcactgcttaagtcagttgtttggagaaaacactcttagttgcgttgaagctggggtcattgctcctattgtcggtattattggcagcttgcaagcattagaaacaattaaagttttacttaatattggtcaaatgttgtctggacggcttttagtaattgatggtttaaatttttctatacgagaaatgaagttgcttaaacagtcaaattgttctatatgtagtaaagaataaggttcaagtccagcaggaggagccaaacgatttcctcctttagttttttgcttttggtcttgttttatttgtctccttttataaaacagtaattcatacctcctagaattagatcaaaagagttgccccgtacaggggctttttttatctagcaaaaatggtgaattaattttgctaataattctcttgtgggttcaataaattttgcatctaaatattcgttaggttggtgagcctgttcaatgttcccagggcctaaaattagtgttgggcagagttgttgaataaaaggtgcttcagtgcagtaattaactgctttacattcttctcctaataatttttcaaccacctttacgatctgggcggaatgttcgcattcatagccaggaatacccgcatgtaaggctttaacttgaatgcgatccccccaagtctcaataagaggtgcaagatattgtcgcactaaatcctctgcatcttggatggctaaattaggtaatggtcgaacttctagttgtagctcacagcaagcacaaatacgatttaaggcatcaccaccatgaatatttccgaagttgagggtaggataagaaacacagaataactcattatggtatttttgttttaagctatttttgagttgaagtaagttacccaccacctcatacataatttcaatagcattaattccattggcaggattactggaatggccagatttaccaataacctgaactgtttgagcaagatggcctttatgtgctcggataggtttaagagaagtaggttctccaatgatcgcacaatctgggcgaatatgtgcatgttgtgaaaaggttcttgcaccaagcatcgttgtttcttcatccgcagtagctaaaatccgtaatggctttttaagttttgctaaatcaatttgattgagaacatcaaccacgaaagcaaaaaagcccttcatatctgcagtacctaatccgtagaatttcccttctttttctgtaagctgaaaaggattgaaattccagagcccctcatcataaggcacagtatctgtgtgcccagccagtaataagccaccatctccttcgccataagttgcaagtaagttatatttttgatgagagccattaatggcgatggtttccgttttaaatcctaaatcactaaaccaataagccaataactcaatcaatgctttattggatatgtcatatttttcattcaggctacttatggtaggaatttgaattaattggcgataacgctcaataaaagagagatgtgttgtcatttattgatcctttcttgagaagagtatagaaacacagcttattagtattttaaggaaagtaagtataatcatatcaatatttaactcatctttttacaaaaaaacgaaaaattcctgttattttatctttagttttgtgttactcatttggttttttttttttttactaatagcgtgcggggacatttgtgcatcctgaaaatgtaaataaaggtttacgatgttttattaggaaaaacagtagagaaggttattatgaataaaatatttagagttatttggagtcatgctcaacaggcttgggtagttgtgtctgagttagtaaagtcttataccaaaacatccgcttacacggataaaagagctcaagtatgcacctcagattattttttagataaacagcaagataaatttaaattaagtcttttaagtctagtattactaggtatattttttagttcagtaggttcagctgttgctaacacaaataccgcaacaccatatcttcaagatggtgctgataaatcgaataaaggatatgacaacggtactattggtattggtaaagagagtaaggcttcgtatggtgctattgctatcggtcagaagtcaaaagctgaaggtaggcataatattgcgataggttatgatgcaaatgcaggagaaaagaacaactctattgcgataggcaacaatactgtagtaaatgagactgaagcagttgctatcgggagtgcttcaaaagcgggaaagggatctgttgtcttaggcagacaagccagtgcggcaaatattgaacaagcagttgtaataggtcactctgctactgcaagtaaggcaaaatctattgttatcggggcaaatgccaaagcggatgggtatggctccatatcaatcggtggagatgatttaaaaacaacgagatatcaacctgaggatacagcccaaggccaaccccaaccccaatcccaatcccaagacgaatccaaaaaaacaaaaataacaactgcgagtggtggagcctctattgctattgggggtggttctttggctaagggcgaaggatctattgttttaggtcctttagcatctgcaagtaaagatgaaggcattgctatcggtgcgaatagtaagtctaccaatgagtacggtattgcggttggtggtagtgcaactgctactggaaactacgccgttgctcttggttggaactcgaaaggtgttgggacagattccattgcgataggtaagtctgcgacaacagcaggggcattttctgttgttgtgggtgcccatatcgatgtgacaggtcaaaacttagtggtagttggaagccaagcaactgctgaaaatcatgctactgccttgggttatatggcctctgctggtggtaggagctctgttgctgtgggtgaaagagccaaaacaaatgctagtgctgctagagcaaccgcacttggtaataataccgttgtcaccgtgggtggcggtgtggcattaggttatggttctaatgcaagtacagctggcggtgtagaggggttaaaacaaaatcattctgtcacaacggaagcaagcactgaagctaacggctttaaatccacacaaaaggttgatggtaataatattggtgcagtttctgtcggtatgggctcaggtaataaactcatcaaacgccaaatcgtcaatgtggcggcaggtacacaagataccgatgcagtaaacgtggcacagcttaaatctttgacgatggaaattggtggtgataccagtgatggtcagccaaaagtggggttgtgggatggtacgcttaaagtaaaaggcgacaacggtcttacttcccatgctagtggcgatacgattacggttaaattaaccaatgagactaaaagcaaaattgataagattgatggcttagagactaaaataaataaaggtattacttttaaaggagatcacgctcttcaaactgattcaattaagctaggggaaacactaaacgttgaagggatagacaagcaaacagttgttactgcacaaaataaaaaacttgttataggtttagatattaatgttataaatcaactggctcagattgacactaaaatgtcatcctttaagattaaaacgaataacactgaagctacaattaaggatggaaatacgatccagtttactgcaggaaataatattaaattagaacaaacgaacggaaagattacgatttctacgattggtaagttaattaaagagactaaaatgctaggaaatggtgatttgcaaattacttatacggatgacagcagtgatactattactaaggggaaagacggtaaaaatggtgagaaaggtgataaaggggaacaagggtctccaggggtagcagggcctagaggtgaagctggtcctaaaggtgaagctggtccagcagggccagtaggtccagctggaccacaaggtaaaactggtcctgcaggtccagctggagcaacaggaccacaaggtccaaaaggacctaagggcgataatggtgatccaggaccaaaaggcgataagggtgaccctggtgaagcaggaccaatgggccctcgaggtcctgcgggtgcaactggtccagcaggaccacgaggccctgcgggtcctaaaggagatacgggtccaaaaggagatgcaggtcagaaaggtgaaactggccctgcgggccctacgggacctaagggtgacaaaggtgatacgggtccagcaggaccacaaggacctacgggtccaacgggaccacaaggacctacgggtccaacgggaccacaaggacctacgggtccaacgggaccacaaggacctgcgagtccaacgggatcacaaggccctgcgagtccaacgggatcacaaggccctgcgggtccaacgggtccagcaggaccacaaggacctacgggtccaacggggcctgcgggtccaacgggaccacaaggacctgcgggtccagcaggaccacaaggccctgcgggtccaatggggcctgctggtccaaaaggagaaaatgtgggaagtggtttaggtttgaaagatgatgctgaatcaaataaaacggcacttacccctacagatgcacaaaaagctattgctggtgataacaaagacggtaaaggcggcttattggctcaaacgggtaatgcgttaaataatgtagcgacagtgaaagatttacaagccattgcacaagcgggcttagacctcacgggtaacaacgccgataccactgtacatcgtccattgggtacgaagttaaccgttgagggtgaaggcaaatggaatggtaaggactcagcggctaataacctttatgtggaagcgcaagaggcagataacaaacttgttgtgaaaatgaacaaggatttaacgaacttaaattctgtgactttaggcactgcgacaatgactggtgataagaatacaatcaaccttactggtgcaggagagaaagtcgaggaagagtttgttaaatgggaccctgtgactaaacaacctattcgtgatgagaatggcaatctccagaaatataaagagaaagttgatcctcgtgtgaaactgagtggtattgctgatggtgatatttcaccaaatagtactgatgcagtgaatggtcgccaagtttatgttttaacctatggtatgaagttcttccacaccaatgatggtcataatgcagaggagcaaattaaccataagtcgaatacagtggattcaagagcttcaggttcatactctactgcagttggttacaaagctcacgcgaaaggggagagttctgttgctttaggtaacggggctacagctggagagcaaggcgtggctattggtcacggtgctgtggcgtcaggtaaacaatctatttcgattggtaccggcaatgtggtgagtggtaataactcaggtgctattggtgaccctaatacaattaaagcagatcgctcttatgcattaggtaataataaccaagtgaatgcaggtcaatctgatgtgtttgttgtcggtaacaacgtgaaaaacacaaccagcaactctgtcttcttgggtacaaactcaggctatgtggcagcaggtgcaaccactgcgggagcgggtgctttagaataccaagtaataggtggtgtgtataacgcttatgccggcggtaaagcaactgaagttgtaggcgtggtgagcgtgggtaatgtagacagtaatggcaaaatggaaactcgtcgtattcaaaacgttgcacctggtttaatctctgagcaaagtaccgatgcgattaatggtagccagttgtatagcttaatatctcagcacaaggtgcatatgggcgatattcacaataagatcaaccgtaataataaagctctgcgtgcgggtattgcaggttctaacgccgcagcaggtttaccacaggtttatctccctggtaaatcaatggttgcggcatcagcggggactttcaaaggtcaatctgcattggctgtgggttactcaagagcatcagataacggcaagctgatccttaaattacaaggtaatgcaaatactagtggtgaaatgggcggctctgtgggggtaggttatcagtggtagatatgataggagcttataacaaattttgttataagctcctattttgatatcacgattacttcacttcacgaatcataatttctgatgggattacactaccttgccaatacagctcagtcgaaacttttaaggctaaatcaaggtaggcttggctgatttcgtggttaggatctgctaccaccgttggcgtacctttatctaaatcttcacgtaaacgaatatgtaatggcatttgtcctaacacttgcgtttggtatttttctgccactttatttgcaccacctgtgccgaaaatggtttcgtggtgtccgcaatttgcacaaatatgtacgctcatattttcaataatacctaacactggcaccgatactctttggaacattgcgatccctttgatcgcatcaagcaacgcaatatcttgtggcgtagtcaccaccactgcccctgttactggaatttgttgtgaaagggtaagttggatatcgcctgtacctgggggcatatcaatgaccaaatagtctaaatcaggccaccacgtttcttggagtaactggcttaatgcactgcttgccattggtccacgccaaatagttgcgttatcaggatccattaaatagccgatagaattagagtataaaccgtgtgcttcaatcggggtaatatgtttattgtctggtgacactggacgttggtttgcagcgcctaacatatgtgggatagatggaccataaatatccgcatctaaaatacccacccttgccccttgtgctttaagagctaacgcaagattgaccgatgtggtagatttacctacgccacctttacccgatgtgaccgcaataatgtttttcacaccatttactgcagggtgactattggcacgttttaaggtggcaatttggtaatttaaaacccatttcacaccgcttgcaccactgacttctttcagttttgcttccgttgttgcctttaattgttcaaatccgctgttccacgcaaaaggtagcgtaaattcaagacgtaaaatcccaccgcctaattcggctttttttaacgcatttaatgcgattaaatctttttgcaaggttgaatgttgaaaaccttgtaaaacgcttttaatgccagctaattgctgttcggtaagttggttcatttacttatccttatgatattgtcgagttaaatctttgctataaatagtttcacttgcattttgttcatcaaagccttgaattgttggagcaatgctcattcggcgttgatattgaaaaagcggtaagattgcgacatcttcttccaattgctgtgctattgtagcaattattctttgccttttagctgtatctaaaggctgttcttgtaattgtaacaacagttcatctactttagcgttgctataactacttttattatcagggctttggctatgaaattgcgttaaaaagagtacaggatcaggataatccgcacaccaacctgaacgaatgagttggaaatctttgtgctctcgttttgcaagtaactcttcccagctaaccgcttgtaattgtactctaaataggtcagactgccctaaagctctcgtcattcgctctgcgatttgtggatgttgcccttgtttatcataactcaaggttaattttagtggattgcctgaatggatcccttgttcatttaataactgctctacattggtatgagaaagtgaatgtcccatttcactaaatagctgtttcggtatcattaaatgtgagggtatgccacttcctttgctgatctctatcggcgaaatcattgctcgcactgcttgacgtattggcttctgagcaaataacggatcattgaagttaaattcataaaagtaattacacaaacgagcaaagtgtttttcgtgctgatgatagctttccaacggattttcgataatatcgaaacggcttggattttgtactgaggtaattaaatgatattgcactacttggaaaggcgtatttttatcccttgctttcagttgcaacagatttttttcaaaatgctcaacgcgataactaccgttactaacgagatccgttgaatttggtttctgacctagataggttggcaacaatgcagaatgagccagcattttaggcagttgataattcgctttttccaactgaacttgtaaagtgtaaggatttaacgccttaactcccaaagcatcaggaggtaattcaccaaccaagacagctcggctattcacaatccccatatagactaaataatgtgctagtggtgaggcatttttagggtcactcaaccgttgccagcttgcaacaaaatctgcggaagtcaccgcctgatcattcgaccatttcgcattttcatctaaaataaacagccagtttttaccatcttcactaaaccactcttttgccacagcattttggatttgccctttaggatcaaacgccatcaagcctaaaaatagatctcgaacaaccccagcttcagcagatattctgacaaaatgagggtctaattgtagctcggttgcgtaaattgcacggcttaaaacattggttggttctgcattaggcaaaggtctaacggaaccgttattctcttctggatcgcaggcaacaaaccccacgatacaagcggtcacaaaaagcccttttttgataaattgcacaatgcgttgaatagatgccattttaatgaattgccgttaatcctggaaataagttactcagtccagctacaataatttcaatacctaatgccattagaattaagcccataatacgggtgacaacatttgagccggttttaccaagacgtttcaccaaaggggctgagaagcggaataaaatataacagatgcctgcaaataagatgattgccacactaaatccgaccaaatctacccaagtatgataacgtgttccccaaacaattgttgaacctatcgccccaggtcccgccataatcggcattgctaaaggcacaaccccgatattttcatattcagacaggtcagcatttttttcttccttattctgcttatgttcgcccaatttaccgctaatcatcgtcatcgcaatactcacaatcaaaatccccccagcgatgcggaaagaattcagggaaatactgaaagcatctaaaatcacttttccaaaaaatagactgacaagcaaaataaccccaacagaaacggaggtgatcaaattagtacgattgcgatcagcttcatactgatgagcagtcatactaaaaaagatcggtaaagttccgaatgggtttacgatagcgaataaaccgataaaaaactgaaggtaaatcgcaaaattaataatgatatccacgggctcctaaataaggactaaaaatttggactattataatcaggaatgttggaaaaggcttgtaaaaatttaattttcttatcgaggataatcaatagacgaagttgtagaaatttgatgtgaatctatttcagtagttccataaggcatttaggaaagctatctatcataatattccatttttgaataaaaaatttcatttttgaattgacatagcaatctagacgtctaaaatagcctagattttaatttttgataaagtgtggattgataactatgattcagctgaaaaatatcagcaagcagtttgaggtgaaagggaagaaaattactgcccttgataatgttagccttgaagtgccaaaaggtacaatttatggtgttatcggtgcttcgggggcgggtaaaagtacgctcattcgttgcgtaaatttattagaacgtccaactatcgggcaagtgattgttgatggtaaagatttaacgacgctttctgagaaagagttaaaccttgctcgtcgtaagatcagtatgatcttccaacattttaatttgctctcttctcgtactgtgtttgagaatgtggcgttatcgttagagttaaaccatacgccgaaagagcaaattcagcaaaaagtcagtgagttgctagagttagttggtttggcggataaacacgatgcttatccgagcaatctttcaggtggtcaaaaacagcgtgtagcaattgctcgtgcattggcaaatgatccgcaggtattgctgtgtgatgaagcaaccagtgcgttagatcctgcaacaacgcagtcgatcttacaattgctgaaagatattaataaacgtttaggcttgacgatcttgttgattacgcacgagatggaagtggttaaacgtatttgtgatcgtgtagcagtgattgagaaagggcatttggtggaaagcggttcggttagtgagattttttccaatccaaaaacagaattggcacaacgttttattcaatctactttccatattgaattaccgcaggaatatatggaacagctttctcaaacacaaacgccaaccagtaagccgatcattaaatttgaatttacagggcgttctgttgatgcaccattactttctcacgcatcgaagaaatttggaatcgactttagtattttgatgtcgcagattgattatgcgggtggtgtgaagtttggttttgtgattgctgaagtagaaggtaatcacgatgcgattgcagaagcaagattttatttgattgataataatgtcaaagttgaggtattaggttatgtggaatgattttatcaatgaactcacaccaaaaatgtgggaattggtggcgttgtccacattagaaacgctctatatggggtttgctgcaacagctttggcggttgttgttggtatgccgattggcttcattgcttttttaacaggcaagggagaaattttagagcataaaggtttacatcaagtgcttgatgtgattatcaatattgggcgttcagttccctttattattctgcttgtggtgttattgccttttacgcgtttactggttggtacaacactaggaacgacggcggcgattgtgccattaagtgtttctgctattccgttttttgcacgtttaacctcaaatgcactcttagaaattccaagtggtttgacggaagcagcaaaatcaatgggggcaacaaattggcaagtggtttctaaattctatttgcctgaatctttgccgattttaatcaatggcattacgctaacgttggtcgctttaattggctattcagcaatggctggtgctgttggtggtggtggcttggggaacttagctatcagttacggcgaacatcgtaatatggtctatgtaaaatggatcgcaactgttattatcgtagcgattgtgatgattagccaaaaaattggtgataatctcgcaaaacgttacgatcatcgttaatttgcaaacatacttttaagaggactttcctatgaacttcaaaaaattattaggtttagccgtggtttctgctttagcattaactggctgtaaagaagagaaaaaagcagaagcaccagcgacagcacctgcaccagcagcacaagcacaaaaaatcaaagtgggtgtaatgtctggtcctgagcatactgttgctgaaaaagcagctcaaattgcaaaagaaaaatatggtttagaagttgaatttgtgttgttcaatgactatgccttaccaaatacagcggtaagcaaaggtgatttagatgcaaatgctttccaacataaaccttatttagataaagattctgcatcaaaaggtttagataacttagtgatcgtgggtaatactttcgtgtatccattagcaggttactctaaaaaaatcaaaaatgtcgctgagttacaagatggtgcagcggttgctgtaccaaatgacccaagtaaccttgctcgtgcattaattttattagaaaaacaagacttaattaagttaaaagataacaccaacttattctctacttcattagacatcgttgaaaatccaaaaaacttaaaaattcaggaagttgatacttctgttgcggcgaaagcattagatgatgtagatttagcggttgtaaataacacttatgcaggtcaagttggtttaaatgcgacagaacacggtgttttcgttgaaaataaagaatcaccttatgtgaacttaatcgtagctcgtaaagataaccaagcaagtgaagcagtacaaaacttcgtgaaagcataccaaactgaagaagtgttccaagaagctcaaaaacatttcaaagatggcgtggtaaaaggctggtaatttaactaaataaaagagagtgatttagtctaggtactagtcactcttttttattattgagaggatataatatgaatttcaaacacttgctaggattaacctttgtttctatcttggttttaacagggtgtaatgagaaaaaagaagtattaaaagttggtgtaatttcaggacctgagcatgaagtcatggaagtggtagctaaagttgccaaagagaagtataaccgtgatttagagttagtgattttcaccgattacgcaacaccaaacgaagccttaaataaaggcgatttagatgtcaatgcgttccaacacaagccgtatttagacaaacaaatcgcagataaaggctacaaattaataccagtaggtaatacatttgtttatccgattgcagcctattctaaaaaaattaagtcaattaatgaacttaaagaaggcgataaaattgcggtaccaaacgatccaacaaatttaggtcgagcactaattctacttgagaaacaagggttaattaagttaaaagacaatactaacttactttcaactcgtgtcgatattgtggaaaacccgaaaaatttagagattcaagaagttgaagcgccattgcttcctcgtacccttgatgatgtagcattttctatcattaatacaacttatgcgggtcaagttggtttgacgccaaccaaagatggcatctttgtagaagataaaaattcaccttatgtgaatttaatagtttctcgtgaagataacaaagataaggaaattgtcaaagattttattaaagcctatcaatctgaagaagtgttcaataaagcgaacgaagtgttcaaaggtgcgatggtaaaaggctggtaatatttgctataaaaatatagatattatttagcagcgaattgttgtgaaatgtgtttggcatatagacaaaagagttggttttaattatttttctaattattaccaactctttttattcatttttaaaaaagagcttaaagccttgtattataaaagattttaagccctatctatgtatgactattttttcttcgcatatttgagcgagtcaattgcaactgcaaagatgatgatactacctttgatgatgtactgccagtatgggtttacaccaatataggttaagccgtagttgataacggtgaagattagtactcctgttaccacgccgattactgtacctacacctccagcgaaagatacaccacctactacgcaagcggcaatcgcatctaactcgtacataaagcctaagttgttagttgcactaccgatacggccagcttctaacataccaccgaatgcatagaaaatacctgcgatcatatagataaccactaagttacgagcaacgtttacaccagatacttttgcagcttctgggttaccaccgatagcgaagatatttttaccaaagcgagttttgttccacataatccaaacaaggattgaggcaatcgccgcatagatggtaatgtaagacaatctaaagctaccgatttggaagaagccttgtgcaaaggttgagaaactttcgtcaaagcctgcgattggtgatgaacctacagcatcatagtagagtgagttgataccatagacgatgatcattgttcccattgtcgcgataaacggcgttacgttgagataggcgataactaaaccattgactaaaccgatgacagcaccgatagcacatacagttaaaataaccactggaattggaatttcgcctagatttgggaacactcggttcatattatccattgcttgtagcattgttgcagcaaccacagcggctaaaccaacttggcgacctgcggataagtcagtaccttgtgatacaagcaaaccagcaaccccaagtgcaatgattaaacgcactgaagattgggttaagatgttactaaagttgcgtaaacttaagaaacttggatcttgtgcgataatgatcactaataacacaagcaatacaaaataaatcgcattttgtttaagaaaatctaaagatttagtttgagtaagtgtggacataattcacttccttcttttataaatatttcgcagaaagctgtaaaatctcttcttgagatgttttagctgtttctacgatccctgcaactctaccattgctcatcactaaaattcggtctgtcacccctaataattcaggcatttctgatgagatcataataatgcctttatctttttgagccagttgcataatgagctgataaatctcatattttgcgccgatgtcgataccacgagtaggttcatcaagcataagaatttcaggttgcgttaatagccaacgtccaataactactttttgttggttaccacctgacaacgatccgatatttgttttatgagatggtgttttcacattcatggaatcgatcacccattgggtatcgctcttcattttagcactgctgagtaatccaaacgaacctaagtaggatttcatattagaaatcaatgagttaaattcaatgcttaagttcgcatagatccctgttgaacggcgttcttccgtcaccagtgcaaagccgttgttgatggcttctaaagcggtgtgatttgccatttcttttccgtgtaatttcactgagccttcttttcgctcacgcacgccgaaaatggtttcgacaatatccgtacgttttgccccaactaagcctgcaatccctaagatttcccctttgcgtaattcaaagctgacatcttggatagacggttgatttttggcagtcaggtgttgtacttctaaaatcacttcttttggtgtattggtttttggtgggaagcgttgagttaattcacgtcctaccatcatagatacaatgccgtccattgtcgtttcttttactgggacagtattgatccatttaccatcacgcaagatcgtaatttcatcacaaattttgaaaatttcgtccattttgtgagaaatatagataatgccacagccacgattttttagtttttcaataattttgaacagatgttccacttctttttctgaaagtgaagacgttggttcgtccataatcacaattttagcgttataagagaacgccttggcaatttcgatcatctgcatttgtgatacagagagatttgccactttttcttttggatcaatatcaatatcaagttcatcaaaaatcgctttggtgtctcgatacatttttgcgtgatccacaaacatacctttcaatgggtagcgaccaagccaaagattgtccattacgttacgctgacggacaagatttaattcttggtgaaccattgaaattccattctctaaggcttctttagaggttttaaaattaacaggtttgtctagaaatagaatatcgccttcatctttggcatagataccaaataaacatttcagcaacgttgatttacccgccccattttcacccattaaagcgtgaaccgaatgagaacgaacagtcaagtttgcgttatctaatgcttttacaccaggaaaggatttactgacattggtcatttggagaagcacttggctctctggatgttctgtgttttctgtcatatccaacctcacaaaataaggggaggtttccctcccccaaactacaaatcattattttaagaattcagaaaggttatctttatctacgccaacataaggaatacgtaatactttctcttttaattcccatttagtaccttcagttggtgctttctctgcggctaagtttttagcgagatgcacaactgctttaccttggtttacaccgtcatttaatacagtacctgcaatttcacctttttggattaattgaagtacttctggtaacgcatcaacaccgaagataggtaattttttaccgtgtgctttagctgcttctaatgcacccatcgccataccatcgttgtttgcaatcacaacttcaatgttgcttgcttttgagctagataaccaagcatctactttatcttttgcaagcgctgcgtcccacataccagtatctacgaagagttcttctgtttggatacctaatttatttaattgctcaacagaatatttagtacgagcttcagcatctgggtgacctggttcaccttttaacataacgtattggattttaccgtctttgtttaagtcatacgctgggtttgctttccagtgtttcgcaattaattcaccttgaattacgcctgactcttgtgggttagttccaacgtagaatgctttgtcgtagctaccgatagctgtatcacctggatctttgttaaagaataccacagggataccttctggttttgctttaccgataatggttggagctgctgatgggtcaactaagttgatcgcaagagctttaacgccttttgaaattaatacatcaacttggtcgttttgaattgattgagcattctgtgagtcgttcattaataaatcaacaccacccactactttcgcttctttttcaatttcttgacgcattaacgacataaagttgtcgtcatatttatagattgtcaccccaatgcgatccgctgcttgtgctgttgatgcgattgcacctaaacctactgctaatgcgattgtactaagtaccgcttttttcataattagctcctatatggatttttgaatgagataaaattgtcactatcacagtaactcttggaattttactccaaaaaaggaaaaaagaatgtgatcacactcacaaaattgcaaacgttttcattacatttcaccaattgctgaaattgtttttaacttacacttaatttttctaacccattgtttttgcgatatttttttatcttcagattgtttttcaaacactgcttgtaaaaatgtaatcgagggttggttaatatacagacgttttaagcttgcataacaagcagaaagagttctttgatgaaaaacaaaaccttgcacattttttttatcaataaaattaaaaagatactgctcttttgctggcaaaattgaaatcgtattttgcaatgtatccgcaaaaggcaacagcggaaaatctcgttcaaactgttgctttgcttgttgagcaaatattttcccttgtacagagagcggataaatcatcattgcactgtgatagccactgcttgcttcaggggttggcgtaatctgaactaaattaaagccacaagattgccaaaaatacaataattcaggagtaagcccaaaactgaccgaaacaaaatctacaagcggtggcatttgcgaaataatctgcgaaaccaaccgcttgccatagccttgcttttgatattcaggctgtaccgcaatacgggaaattcgcacagacttcaaacggcaagcatcaggtaaattgccttgaaaacagagatattgagcaaccaaattcccttgcggacggcgttcgccacgccaaatagcttgagtgagttcatcatctaatcccccttcattcaccgcccagcaacccgcgatcaacttttcctgctcttcaagataaaaatagcgttgatcaggtgcgtcaaacagacgacgcaaatccgttggcgttgttttgtaatgtgcttgggcgagtaggtgataaaagttaattaatttatccaaataacttcccccctttgaaaaaggggggctaggggggatttgatattctaataataacaattgattaacaaaagcctccaacggatcattctccccccacctcaacggttggctcaatgtccactgtttcgtagaacggcttaatgtcggcaaaaacttcaaacaaaaaccacgcccagtaccttcataattttgagttgttgtggttagcaccactttatcaaaataggcacaaaactgttgcaacatcggcaaaggtaaactcgctgcttcatcaataaatagccattgcttcggtgagatattttgctgttcgatcatctgaattaaacgatcaggggcaaagaattgcactttatcactttcaatccccttccaaaaatttggtaaggctgaatggctacgggcggtaatggataccgtatattgctgagagagcttttctgcgagcttgcccgataatgtcgatttgccacgaccacgagaggcgagaataagatgaacatcggcaggatcaagcggtaagttatcgaagatattttgctgatcttgggtaaaaacaatttccccccttccccctgcttcgcagggtacttcccccgtaaacgggggcagaatttcattgaccagcgttttaaaataacgaaagaaattcggtgtagcaatcggctgttgagcgttccaacgtaacgcatcaaaatcgacttgttgctctaaattatcccattctggacagaccaaatagagcgtgccaccttcttgaatagtgcctgccacaatcgccaatgcgtcaagatttaggcaaacaccgccttcagctcgcatatcataaactgcataaggaaattcttgaccgagtaaggttttagcattagaaaaggggagagatatcggcgaatcaggtaagaaaataccgccgacatcggcagtctcaaaagaagatgggagatgatcgataaccgttagatgacgcattattcttcaatcgttttttccgcaatatagggatcatcaaaccctagcgactgcataatttccgtttccagactttccatttcttcggcttcttcatcggttaaatggtcgtagccaagcaaatgtaatgtgccgtgaatggctagatgcgcccagtgagcttcgagcggtttttcttgttcaaccgcttctttttcgacgacctgacgacagataattaaatcccccaacagcggtaactgaatcccttctggcacttcaaacgggaaagagagtacgttagtcggtttgtctttgccacggtaggttaaatttaactcgtggctttcggcttcatctacaatacgaatagtgatttccgtttcaggataatccgccgttttcgcttccatggctaacgctttatccacccagtgttgaaattgagcttccgtcggtaagcctgctgtattttcagaggcaagttggagatcgatatataaattcatttgcaaaattttcctaaaatctaaccgcttattaccacttatccgccgcttgttgatcgctttcacgcctttcaatccaacggtcgccgtgatcggtggtttcacgtttccagaatggagctttggtttttagatagtctataataaattcattggcgtgataggcgttgcctcgatgagcagaactgacaccgactaaaacaatttcatcacccgtataaagctgtccgatacgatgaataaccgcaacacgttgcagttcccaacggcttcttgcttcatcaacaatttctcgcaaggctttttcggtcattgcagggtagtgttccaagtataaacctgacacgctatcgcccaaattcatttcacgcactttgccgacaaaaagggtagttgcaccaacggaatgttgttcactcaaccatttatagatcgcattttgatcgaagggatcttgttgaacttgaataagtgtttgttccatttagcccccagttactggtggaaagaaagccacttcatcgccgtctttaatttcagcagacaaaggggaaatagtttgattaatggcgactaacaatttccctgcttgtaatgctaatgcccatttgttgctacgttcggctaaatgttggcgaagctgttcagctgtggcaaaggttgcttcaacctctaagctatctacgcccactaattcacgggtttgggcgaaaaagagtactttaatcatttttaactaatcttattaataatttggggtctattggggcaaatatgatttgcccctacaaaatattatggtttggcaacgaaatcgcctgatttcccaccgcttttactgagcaatcgaacttgttcaatcaccatatctttttgtaccgccttgcacatatcataaatcgtcaaagcagcggcactggctgcggttaaggcttccatttctacgccggttttgcccgacagtttgcacagggattcaatccgtacttgatttttttcaggtaatgcttcaagttgcacttccactttagaaagcagaagagggtggcaaagagggattaattcccaagttctttttgccgcttgaatgccagcaatgcgagcagtggcaaaaacatcgcctttgtggtggttgcctgaaatgatcatctgtaacgtttcagggttcattgttacaaaggcttccgcacgagcttctcgcacggtgtcttgcttggcagaaacatcaaccatattggcttcgccgttttggtttatatgggtaaaggtgttcattattttctctttgtaaaatattaatgatgtagcaactgtgtttcataatagatttttggacacacgcagtgtgtccttacagattaccctccaatcgatgccaaattatttctcacgccactatcgccaatatgcaaataatggtgttcgcgcttgccttgcagagcggattttaatctggcttcgagttgaaattgttgctcgtccgattgcaataaatcccgaatatcaataccttcttcgccgaacaaacaaaggtgcaatttgcctaatgccgacactctcaaacggttacagctggcacaaaaattcttttcataaggcataatcaaaccgatttccccttgataatcagggtgggcgagaactttagcagggccgtcagacatcgctttgggttgtaattgccaaccttcttgggttaatcgttctaaaatagattgccctgaaaggtgctgttgctggaaaaagtgatccatttcgctggtttccattaactcaataaaccgcatttgaatagggcgatctttaatccaacgcaggaaatcgtccaaacctttagcggtatattgcttcatcaacacggcattcactttgacttttttatagccaatttcaaaggcacgctcaataccgtttaacaccgttgcgagtttattttcccctgtaatcaaatgaaattgacgtggctcaaggctatcaacactcacgtttaaatgggtaattccagcttgttgccataactcaacatcacgttccattcgataaccgttggtagttaatgcaatttggcgaatacctgccgtttgtgaaaggcgatgagcgatttctaaaaaatccttgcgtaaagtcggctcgccaccagtaatacggattttctctgtacctaaattggcaaaggcttgagcaacacgttgaatttcatcgacagacagaaaggtttgtttatgcgacggcggacgatacccctcgggcaaacaatagttgcaacgaaagttacagacatcggtaatcgacaaccgtaaataagtgtattgacgctggaaacggtcgatcaaagcttgctcgaactcgttccctacatttctaattgggatttgcaatgtgacacctttctaaatatgagaggagagccgatttctcaactttccctgtgtaatcaatcaattacaggcacagtttccatatcgctagacttaggaaaacaggctcggggtcggataatgttgggaattgtagtaactgaatgacaattaagcaagaggttgttatgtgattgtttaattaagcaacgttattttatcggggcaaaccccttttgatacatatcaaggtttttatgatggtttctgttaggctaatcctatttttatttaatggaaaaagagtaatggataaacgcacacactggtcgtgcttggtcgatacacaagcggtggttttagagtgggaagatacatcagggggtttaaaagaattgcaaaaaatcccaaactgggataaagtgtaagttattcagagggatcgttatgcgaattatttcaacatcaaaattggtggattattacactaaccaccctgaaacagagcaaccattaaaggcttggatttcagaagtaaaaaaagcgaattggcaaaccgcaaatgaaattaaacaacaatatagaaatgcgagtattctaaaagatagacgagttgtttttaatattaaaggaaaccaccatagattagttgttgcaattgcctataaattaggagcggtttatattaaatttattggtactcacgaagaatatgacaagatagacgcaaatagccacgaacaagcataggagaaataaatgaatattaaaccacttagaactgaacaagattaccaagaagccctttctcttattgaacctttttttgataaagaagatgagctaacccaagatgaattagactattttgatgtaatggtgacattgattgaaaattatgaagcaaaacattatccgattgatccacctaccccgattgaagcgataaaatttagaatggagcaggaggggcttaatatcaaagatttagatggtattatcggaaaacctaatcgtgtatcagaagtttttaataagaaaagaccattgacactaaatatgatccgcaatattcatcataagatgggaattagtgcggatatccttattcagacagtatagtattgttttatgtgggattttttcccccattaacatttgatatgctgtcattcgagcggttatttgcaacaaagcaacatattacagatactcaactgcttgaagccattcaacgtgcaaagaatggtctaatagatgcccatttgggtggtaatatcatcaaacaacgtattaccaacaaaggctaagtacgaaagtgcttagccttttgttttggcttaaaaaggaatgtgatatattgcacgaaaattttaaggagatacgatgaaaaacaaatttcttcttttttcagccctaagtggttttttctgtatcgctttcggggcttttgcggctcacggtttagagaaggttttagatcagaaagcgttggtgtggattgaaacaggcttgcaatatcagatgtttcatacgttagcattgatggcgttgggtttatttcaaattgcaaatttctcgaaaaatccgcccgcttgcagagccaaagcctttaacattattggcggtagttgggcgttagggattttgctgtttagtggcagtttatatgcgttagccttaggggcaagccgaatttttgtttggacaacgcctattggcggtacactatttttagtgggctgggcagcgttggtttatattagtgtgagaagtcagaagtaatgaataaattagccttatactgccgtgcaggttttgaaaaggaagtggcaggtgaaatcaatgataaagcggctcaattgggaatttatgggtttgctaatctcaaagagaacagtggttatgtaatttttgagtgctatcaagcaggggaagcggatagattagccagagaattagcctttaatcagttgatttttgttcgtcaaatgattgtggtaggcgagttgttgcaggagatacgattgcttcgttattagagaaacaagggctgaaatttgctattcagacaaaacatttgtatcacgatagggaagagattaccatacatattaaattagtataggtctggagaagaaaatgaaattgattaaaaccgcctttgtttcaggtttagcactcttatccgccaccgcttttgcaacccaatgggaaaaaatccgcacgcctgtggtgggtaaggctcaatccattggggggtatagcaacggttgtattatcggcgctcaaccgcttgcattaaaaggcgaaggctaccaagtgattcgttctgtcaaaaatcgttactacggacaccctcaattattaagctacttaaaaaccttagcaaaaaatgctaaagcatcaggcattccaccgattttaattggggatatgggaatgcctgctggggggcgtttttcttctggacacgctagccatcaaacggggctagatgccgatatttggcttcgttttggtccaatggatgatgaaacagctcgcaatccagctggtttagcgatcattatggttgatcgtaagactaacgtagtagatgaacgtctatggacggcaaaccatacaaaactactcaaactcgctgcgtcagatccaagagttgatcgtatttttgtcaatccagcgattaaagtgaaactctgtaataccgcaggaacggatcgcaactggctacgcaaaattcgtccgtggtacgcccacgactcgcattttcacgttcgtttaacttgccctgctgatgcggtgaactgtgaaaatcaagcccctgtgcctgctggtgatggctgtggcgaagaactttattcttggtttgagcctgcaccaccatcagcaacgccaaaagcaaaaaccattccacaaccgccacaactttgccaaatgatcttattatcacaaggtttataagcgacttatgcgtttattcattgcagaaaagccaagtttagggcgtgcgattgctgatgtattgccgaaaccccatacccgtggggacggctttattcagtgtggcgaagacaatgtggtcacttggtgtatcggtcacttgttagaacaagccgaacccgatgcttatgatgaacgtttcaaaatgtggcgaatggagcatttgccgattattcctgaccagtggaaactgatccccaaaaaagagacgctcaagcagtttaaagtggtagagcgtttaattaaacaagcggatattttagtcaatgcaggcgaccctgatcgtgaagggcaactgttggtggacgaagtttttggctacttaaatttatcccctgagcggaaatcccaaattcagcggtgtttgattagcgatctcaaccctaatgctgtcaaaaaagcgattgaaaaattgcaatttaatcgagatttcgtaccgcttgctacatcggctttagctcgtgcaagggcagactggctatatgggatcaatatgaccagagcctatacgctacaagggcgttgggcaggttataaaggcgtgctttccgttgggcgtgtacaaacgcccgtgttgggcttgattgttcgccgcgatcttgagatcgaaaattttatcccaaaagattattttgaagtgttggcaaatgtggttgtctctgaaacccaagagctttttcaagcacaatggcaaccaagtaaagcctgcgaagattatcaagatgaagatggacgagtactttctcgcccacttgctgagaatgtggtaaaacgtatcgccgatcaagccgcttgcgttaccgaatatcaagataaaatggaaagtgaagcagcaccactcccttattcactctcagccttgcaaattgatgcggctcgccgttttggcttatctgcacaagatgtgcttgatgtttgccaacggctgtatgaaacccataaattgattacttaccctcgttccgacaaccgttatttgccgaatgaacattttgccgaccgcctaaaagtgatggcggcaattgcttatcatctgcctgagtatgctcaaaagcccgatgctgttgatccgaataagaaaaaccgttgctggaatgacagtaaggtagaagcccaccacgctattatcccaacggcacgtcaagggcaagttcacttaacccaaaatgaacagcggatttatcagcttattgctcgacaatatttaatgcaattttgccctgatgcagaatatcgtaaaggaaaaattgtgttaaatatcgcagggggaacttttgttgcgcaagccagaaaccttgttgttgcaggttggaagtccttgttaggcaaagaagataatgatgaaatcgttgaacctttgctacctgtggttaaaaaagatcagcagttatggtgtgaaagcggtgagatcgtcagcaaaaaaacacagcccccacgccattttactgatgcgaccttgttatccgcaatgacgggtattgctcgctttgtacaggataaacagctcaaaaaagtgttgagggaaaccgacggcttgggtacagaagccacccgagctggtattattgaattattattcaaacgtggctttttaatcaaaaaaggcagaaacattcatagtacagaagcaggacgaaccttaattagtgccttgccagatgttgcaacacagcctgatatgacagctcactgggaaatgcaactaacagacatcagcaaaaaacaagccagttatcaacaatttatggcagatttaaaccaacgattgccgagtttattacgttctccaaatcagcagattttgcaaaatttggcgaaaataacaccgcttaaaatgggttctaaatcacgttatgcccgtaaatctacgcaaaatgttgaaaaataaaccgaatacacagaaattgataaaatccacttgcaaggaaaagtaaagatagctattattcacgccatcgaaagttaattccgcaacctgcggaattttattttgaacagattaaagagaacacaatgttaattaatgtactgactattgtttatctcgttgttgcaatcttcctcgttggctttattttaatgcaacagggtaaaggtgcagacgctggtgcttcatttggtgctggtgcagctggaacggtatttggttcagctggttctgcaaactttttatcaagaacaacagcgattttagcgattatcttttttagcgtaagcctagttataggcaacttaaattcacaaactgcagcaccaaaaagccaatttgaagatttaagtaacgtagagcaaaaacaagaagttactccagctaaaatagaaaatagcgatattcctcaataaaaatagaatttacgctctggtggtggaattggtagacacgctatcttgagggggtagtgtccagaggatgtgcgagttcgagtctcgcccagagcaccatttgactttacgtagctgttcgtagcttatcgtaaaaactaaataaagccttgaatatcaatgattcaaggcttttttcttatctttttatatcgtaatttatcgctacctatctcacattttagtaacacagttagtaacacagaacaatctcgtgttactatccaaaaaccgtttaattgttgggaaaatactcatggcaagaaaattcacacgattatcagcaatggaaattaaagaagctaaacccaaaaataaagaatatagtctgcatgatggggatggtttactattaagaattagacctactggaagtaaaacttggctctttaattattcaatcccatttacaaaaaagcgaactaatctaagaattggctcttttcctgaaatttcactgattcaagctcgtgcgaaacgtgaagaatttagggctttacttgctcaaaacatagatctacaagcagagaaacttagacaacaagaagaagctcaaagccaaattagagatactttctattcagtctcaacaagctatttcaacggtatttacaaacagaaagccaaaaatgcagaaacacgtgaaaataattggactagattagaaaatcatatttttccttatattggagaaaagcacgtatcagaaattacggtaagaactttagtacaagtttatgaaaaagctgctaatcgtagtaatactttgaaaaaagtccatcaacttgtcagcgttatcatggatcatgctgttacaaaaggaatcatagaaagccataactgcagattggctattaaaagcttttatattgaatcatcaaaacctaatcccacaattaaaccttctgaattaccaaaactatttcaagacctatcaaattctcaaatatcaaaaaaaacttactttttgatctgttggtcatttttgactgctttacgcccaaatgaagcagttagtgcagaatgggcagaaattgattttgagaataaactctggaacattccaaaagaaaagatgaaagggcaagcagacaaaaaacgccctcatactgtacctttatcttctcaagcaattcaattattagaaatcatgaaattcttttcggaaggtagccgttttatttttgttggtcgttcttcaaataatcaaccaatgaataaagcaactgtaaatgtcaccctaaaaagaatcggatataaaaataaacttactgcccatggaatacgagcatttataaaaacatttttagcatctcaaaagattgaaagaaatgtatctgaaactgtactttctcatttattggaaggaggggacgatttagaaaatacttataatcgatatgattacttagaagagcgaaaatctgtgatgcaacttatcggagattactgcgaatcccgtggtatggatttaacatttgatgtaaaaaaacaaagcctataatatttttttataaaaaatggagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggccgcgttaaatgatgaactgaccgaccatcttggttatctaaaacgaaaattcagctttgcattgtgcatttagtgcgtaacagcttgaaattcgtttcgtggaaagattacaaagccgtcaccgcagatttaaagcaggtttatcaggccccgacggaagtacaagctcgcgaaaatctgaccgcactttcgcaaaaatggcaggcaaaatacccgcttgtaaagatgcatcaaaaaaatggacaatgccgattcagaactggaaactggcgatgaatcgatttatgattgattctggtgatcgcttagacgatcaccgttaagttgaaatgggtgtttacacagaatttgggatagggtcacgccagatggaactcacatcaccgtcgaattattaaaaacaatgagaggtatcgcaagggacgaaagtcagaaagcgatcaccaataatttcgctcgtgcgggtggtcaatttagacgataggagtatgtaatgccaaaatccctaccccaaaaaatggcaaacgaattgccaaaactggaacaaaatgccttgattgaactgtgggaaattgatttaaggcatatcagcagtaatagcgaccaaacacaaaaaggggagttattacgctttcacaatggcttaaatcaaggtcagcagaacatttggtggcaaggtaacgagtaccaagcctatccaattcaagcggacggttttgagattagcggtcaaggtccgagtaatcgaccgactttaacaatctcaaacctgtacggcattgtcaccgcattagccgcagatttcgggcaagggattggggcgaaagtgacacgtcgtttagtttacgctcaattccttgatgcacgaaattttcctaacggacaaaatccacaagccgatccgacacaggaaagtgtgagtttgttcattattgaacagctaaaaatcctcaatgatgaagtggcgacatttgagctggctttacccgcagaaacagataatgcacgtattccgttgctgatgattacgtctgatacttgcatttggccatatcgttctgcggagtgtggctacacaggcggacctgttgccgatgaaaaagataacccgacaaccgatccgaaaaaagatgcttgctctcactgtttgcgtggttgcaagttgagatttggggctaatgctattttgccgtttggtggctttccaagtacgacgcagtatggggcttaagcaaatagcggttctatgtgaaatgtagcacgctgttctaattgccacaaatcaaaatctgcttgcatacctaaccataattttggtgtggtattaggcaatagctgacttaaacggagtgccatttcaggggtaatcgctgatttttcattgataatacgagatagacagacacgagtgacaccaagttgtttagcaatttgagtaatgctagtgtcggcattatctaggtattcttttagcaacaagcctggatgtggtgggttaaacattctcattcttcagctccttaatgataatcttgataatccacaatttctgcgtgaccgttttcaaatttaaaggttaaacgccagtttttattgactttgacactccaatgcccaacaagattaccttgtaatgggtgtaaatcccaactagggaagttcattgcagaaatagtttcagcgttctctagtgtcgcaagttgaagacgcaatttagaagcgtgattagcttgaatacctgctgttgaacctgtttcaaaaaatagctttaagcctttatgtttaaacgagagaatcattgtggttatcctttttgtatacagtaagtatacacttaaatcttaacttgtaaataggttgtatacaataatgcaaaatatctcttttacagaacaaattttatatcacgccaaacgctcagaaccgcacgaaagttgcggttttgtcgtttttaagggcggtgagttacgttatttcccttgtgaaaatgttgctgtcgatccgattaatcactttgaaatcttgcccgatgattggattcgggcggaaagtgtggggggaattgtggcggttgttcattcgcaccctgattcggacacggaaaagggcttgccgtatttatcgacggctgaccgtgaatgccaagtgcggttaaatttgccgttttggttggtgtgcgacggaaaattgcaaaaattccgcccaatctagagatattagatttaaatagtttacaccaggcattacaaattgatataaaccgttatatttcatttttggatcaaaagcctaacatattagaaaaaatagatgctgataattcagaggaagaaataattgagcgaccaatttatctaagttttgtaagtccacaaagtcaatctataacaacagggtattttgcagaggctttttcctacacccagggtataacgcctagcaaggctgttgaattacttcacagtaccattattgatgaatttagaaaaaatgaacaactaaaacatcataaaactctcgaaaaattatcgatttctttagatcgattttatgaaacctataaaaataaagtgatcaaacttgaggatataaaagctgttattattcaggctattcctactcagttacaccatcaagcaacccgtattgcgaataaaattatcaacaaattaaatggagaaagtcacttgatttgtcccaatgattgccttggctacgctaatagcatatctcattttaacagatcctcataatctgacggcttgccaataaaaaactatgatatagggaataaggctctgttgtgtacaattattcttttaaatcaagtaaattgtgatttacctctcattttttaggtttataccttgtcatttggtcgagaaagttttactctatggagtatattttcttttatgctattttttatggagtaatcttttcatttaatgtgcggtgaaacattaggaggctatatgttattaggtgatctttctcgtgatgattatattctttcacttccgcctgtctttgcaagactatgtactaaacttaaaacccttgatttagttaatctgccattaggttggcaagatttggaagagggagtaagaatgaatgtgatggaatttgaaacctcttccccagaaggaaaaaaagcggagctccatcgtaaatttattgatattcaattgttgatatcaggtgaagaagcgattgaatatagtttagcctatcctaacttagcactttatgatgaatatcgtgatgaggacgattatcagcttacaccaaccttagaacataaaaatgttgtaattttaaaacctaatatgtttgctattttcttaccttatgagccacacacaccaggcaattttgtgaccgaaagtaagccattgaaaaaattagtggtgaaagtgccagtggagatgataggaggctagaatgtcagcccgaggtaaaattctagatacgattggtgcgttacaaaatagtttaactaaaacagagaaaaaaattgcgacggtgattttatctcagcccgatctattgaaccaatgttctttatctaaagtggcaaatcaattagatgtcggcgaagcaacctttattcgtttttgtcgaacattgggatttaaaggttatacagactttaaactcgatcttgccattgaattggctactcagcaaaaagagagtagtacgttgttagatacggacgttgcggaaactgatacacctaaagaaattgcaattaagttgcagaatacgctgaataatgtgattgcagaaaccgtcaatctactcgattatgcagagctagaaaaagtggtggaagaattgcgtaaagcagatcgtattttcttatttggtgtaggttcatcaggtttaacggcagaagatgcccaacataaattaatgagaatagggctacacgcggctgccgtgactaataaccattttatgtatatgcaagcagcattgctgaaaaaaggagacattgttattggcattagccattctggttattcagaagaaacgacaaaagctctaaaaatatcaagagataatggggcaataacagttgctattacccataatttgcgttcgcctattacagaagaagcggattatgtgttaattaatggtaaccgtcaggggcatatgcagggagattcaattggtacaaaaatgactcagctttttgtactagatttaatttatgccttgttagtgaaagctgaaccagaaaaagcgattcaacaaaaacagaaaacgttgagtgttattttagatcaacggcttaagtagtttacaagcggtcagtttgatagtttttttgtgaaacagaccgctatcatttatctatactttactttaataaggaaacccatatgaaaaatttaaaaggtattttcagtgcattattagtttcttttaatgcagatggcacaatcaacgaaaaaggtttacgccaaattatccgttacaatatcgacaaaatgaaagtcgatggcttgtatgtaggtggttcaacaggtgaaaactttatgctatcaacggaagagaaaaaagagatcttccgtatcgcaaaagacgaagcgaaaaatgacattgcattaatcgctcaagtcggtagcgtaaacttaaaagaagcagtagaacttggtaaatatgcaacagaattaggctatgacagcttatctgcagtaacaccattctactacaaattcagcttcccagaaatcaaaaacctctacgaaaccattattcgtgaaacaggtaacaaaatgattgtttactctatcccattcttaacaggagtaaacatcggcgtttcacaatttgcagaactgttccaaaatgaaaaaatcattggtgtgaaattcaccgcaggcgatttctatctattagaacgtttacgcaaagcattcccgaaccacttaatctatgcaggttttgatgagatgatgttacctgcaacagtattaggtgtagatggtgcaatcggtagtaccttcaacgtcaatggtatccgtgctcgtcaaatttttgaattagcacaacaaggaaaagtcaaagaagcccttgaaattcaaaatgtgactaacgatttaatcgaaggtattttgggtaacggtttatatcaaaccatcaaaggtttattggaagaagaaggcgtacaagcgggctactgccgtgagccaatgattaaagagttgaacgctcaacaaaaagcagttgtgaaagaattaaaagcgaaatatctttcataagtaaccctcctataaatattgatagtttttgtagaagatcagaattgatcttctacaaatgtttcatttactttttaccccttccgcacaagcaaatgccgacgaccacgcccattggaaattatagccaccaagccagcctgtcacatcaagcacttcgccgataaaatatagcccctgcacgtttttcgcttccattgttttggacgaaatgtaatcagtatcaaccccacccattgtgacttcagcggtgcgatagccttcagtaccgtttggtaaaaactgccagtgatgaataaagtgatctaaaaaagcaagatccgacttattcagttgagcgataatctgatctttgatcatctgttgctcaatccacagttcgactaattttttcggtaaatagcgagataatacggtttttaattgcaatttcggcgaagattgacgcaattcgttcaaaatatcaaggatagaggaggacggcagtaaatcaatttccaccgtttcacccaaatcccagtagtttgaaatttgtagaatagcaggtccagataatccacgatgagtaaacaacatctgattgctaaaggttttattacgattgcttacgctaacgggtaaagcgataccagataaggtagcgaagatcttatcacactctttccaagtaaacggcacaaggcttgcacgaacggggataacgggaataccaaactgctcggcgattttataaccgaatgagcttgcccctaagccagccattgataaaccacctgtggcaataatcagattttccgtctgatagctttcgcaagcggtctgaatgtggaaaaaatttgcagatttttcgatggaattgaccgcttgtcgaagttgaatataaactttgcctttctcacattcagcttgtaacagatcgacaatctgttgcgaactttcatcacagaacagttgccccaactctttttcgtgataacagatgccatagcttgccaccagcgaaataaaatcccagttggtatagcgagccagtgctgacttgacgaaatggcgattttggcaaatataatggttgggagtgacatctagattggtaaaattacaaaagccaccgcccgacattaaaatcttccgcccgatttttttgccgttatctagcaccagtactgattttcccccttgcccgatctgtgccgcacaaaataaacctgccgctccagcaccgatgatgattgcatcaaattgtttcatatcgccctttttattcaaaaaatcctttataaacataatcttatgctttttcgttaatccgctatgaagcgataatttctgtttcagttctttaaataacccttccaacctatttgttgttttttctatatttaggtgagtatattcttcaaaagtgagcttaaagccttgtactataaggctttagcccactttttaccaacacttttgtctactatgccaaatatcctatctaaatcaccgctttcattagatttccgcctattatttctaacttttttaataattgacaataaaagttgaaaaatgcttgttattttattcttagttttgtgtaactcttgttttttttttttttacaatggggtgggggaaaggtatttttgagatttccccacttgtgggggaagtagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtacatcctgaaaatgtaaataaaggtttatgattttttattaggaaaaacagtagagaaggttattatgaataaaatatttagagttatttggagtcatgttcaacaggcttgggtggttgtgtctgagttagtaaagtctcacaccaaaacatccgcttgcacggataaaagagctcaagtatgcacctcagattattttttagataaacagcaagataaatttaaattaagtcttttaagtctagtattactaggtatattttttagtccagtaggttcagcagcatggttggtagatggttctgaaagaggaagtgacgctgacactggttctattggtattggtcaaaatagtagggttgggcctggttctattgtcatcggtcagtacgcaaaagctgaaggtaggacttctattgcgataggttatcaagctgaaacaaccggtgacaaagccgtagccgttggggcaactgcacaagcattcaattattctgcggcttatggttatggagcacaagcaaaagcaataggcgctgttgcagtcggtcaagaagctattgcaaatcaaaatggaggcgttgcattgggttaccaatcatctgttaacgttaccaatggtgttgcattgggttctttctctagcgcagatacgaaagggggtattgaaggaacaaaacaacctttttctgtgacagaggaagcaagcactgttgagaatggatttaaatccacagaaagtcctgatattggtgcggtttctgttggtagaagttttgtttggaagaattcaaataaaccaatcaaacgccaaatcaccaacgttgcggcaggtacacaagataccgatgcggtaaacgtggcacagcttcaatcgctcaccatgcaaataggaggcgataacggcagtagtggcaaggtaggcatttggagtggtatgctcactgtaaaaggagaaaatggtattacttcctctgctaatggcagtacgattacggttagattagaggacgaactcaaaaataaaattgataggattgccgctatgggtaagttaattgaacgtacggaagaaacaaatgatggtctaaaaattatctatacagatggtacggataacactatcaagaaaggtgaaaaaggagatcgtggcgaaactggccctgcgggtccagcgggaccacgaggccctgcaggtgaaactggtcctgtgggtccagcagggcctaggggtgaaccgggtcctaaaggtgaaccaggtattcaaggacctaagggcgatagaggcgaagctggtcctgcgggtccagcgggagcacgaggccctgcgggtgagcgaggagaaactggccctgcgggtccagtaggtccaattggaccacaaggtgcacctggtcctgcaggcccagcgggagagcgaggccagcagggtcctaggggagagaaaggtgaaattggtcctgtgggtccagcaggtccaattggaccacaaggtgtacctggtcctaagggggataaaggcgaacaaggtctaagaggtgaaactggccctgcgggtgagcgaggagaaataggccctgcgggtccaattggaccacaaggtgtacctggtcctaagggggataaaggcgaacaaggtctaagaggtgaacaaggtattcaaggacctgcgggtccagcgggaccacaaggaccgcagggaacagcgggtattcagggacagaagggtgaccgaggagaaactggccctgcgggtgcaactggtcctgcgggtccagtaggtccaactggaccacaaggtgcacctggtcctgcgggtccagcaggcccagcgggtactcagggacagaagggggataaaggcgatccaggacctgcgggtcctaaaggtgaacagggtattcagggacctaggggtgaccgaggagaaataggtcctgcgggtccagcagggcctaggggtgaacagggtcaaaaaggagatacaggtcctagaggtgaaacaggagctcaaggtccgatgggtccagcaggaccagcgggagagcgaggcgagcagggtcctaggggagataaaggtgaaactggccctgcgggtccagtaggtccagctggaccacaaggaccgcagggaacagcgggtgctcagggacagaagggggataaaggcgatccaggacaagcgggtccaaaaggagatacaggtcagaaaggcgaaactggccctgcgggtccaacgggacctaagggtgacaaaggtgatacgggtccagcaggaccacaaggccctgcgggtccaacggggcctaagggtgacaaaggtgatacgggtccagcaggatcacaaggacctacgggtccaactggaaattcggaattaaaaggcattacgtcgattgccaatggtaacgacgccaccaaggcgaatggggctaagattaccttgtctgcaggttctacagataaaacagttaatgttaatgatgcgaaaattaccaatgtggcggctggtacagcagataccgatgcggtgaatgtgaaacagttgaaatctgcgaaaactgaagtggaatctaccgatcacagtgtggtgattaaagagcgtcagggcgataatcagcaaatcgtgtatgatttggcggttgctaaaacgaaactcactgcctctaaggataaacgcaccattagtgcagcagataaaggcaaccattttgcgacaggagatgaagtcgcagtagcaattaataccgcaacagcagccgcaagaactgaagttgaagcgggtaaaaatgtgaaagtgacttcaaaaacgggggcaaatggtcagaatatttacaatgtgagcgtgtctggagatttaagcagcattacttcaattagtaatggcgatacgaaagtatctttaggtaaagatacgcaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaacttctgataatggcaaatggcttattcgagcgtctgttagcagtaatactcagcgggatactatgattggaggaggggtaagttttgtgtggtaatctagcacctataaattagaatttcatgctcaatgccattgttattttaacaatggcattaatatctattggatttaatttatttgtggaagaaaaggttttatgacaggatgaacaaaagtacctctgaatattatttttctttccatgcttttggatattgttcttaaggcaaaaaggacagttttttgttcacattttaaaaagtgggcttaaagccttgtactataaggctttagcccacttttttaccaacacttttgtctactatgccagaaacagggtatcatcacctatcaagtacttgaattattaatgccgatctcaaccgcatttattgcttatctgctcctaggtgaaaccatttcatcaatgcaacttgtgtttgcagggattgtgattgttggggcgagtatggcattggggttattacattaaaggaaaagagagagtaaattatattattctctcctgaaaaactacgagcatagcagacaaaaataattaaagtataaaggcttgtctactatgcatttaaaattaaagtacttttacaatcgcttcacacaatgcgtcgatattatcttcggtaatacctgccacattgatacggcctgaacgcactgcataaatcgcaaattcatcgcgtaaacgatccacttgttcaggggttaagccactaaacgagaacataccgttttgtgcaatgataaaatcgaagttttgagttgcacctttctctttcaacaatgccacaaattttgcacgcatctctttgatacggttacgcatttcagccagttcttcaatccagttagcttttaattgtggatcagctaacactgtcgcaacggcacttgccccgtgtgaagatgggttagagtagagtacacgaataatcgatttcacttggctgaacgcattatttgccacttctgcactatctgcaactaaggtaaatgccccaacacgttcgttgtataaaccaaagtttttagagtaagagcttgccactaacacttcacggtgatttttcacgaaggtgcgtaagccaaaggcatcttcctctaagccgtttgcaaagccttgataagcaaagtcaaataatggcaaccaacctttttccgcagacatattggctaggatttgccactgttctggagttgggtcaattccagttgggttgtggcagcaaccgtggaaaagcacgacatcacctttacctgcttggcttaaatctgcaataagattatcccaatctaatgctttagtttctttattgtagtaacgatattctttaatattgatacccactgcgttgaaaattgcattgtggtttggccaagttggggttgaaatccatacgttttgcgtattggtttggcgtttaacaaattctgccgcaatgcgtaacgcaccagtaccgccaaggctttgtgccgttttagcacgtccagaggtaattacttccgcacctgccccgaataataactcttgggtttgtgcattgaaatcagcaataccgtcaatcgttaggtaatttttggtattctctttagccagtaaacgcgtttctgcttcttttaccgctttaacgataggcgtttgccccttcgcatctttataaaccccaatccctaagttgattttctcagggcgagtttctgctttaaatgcttcgcctaaacctaaaatagggtctgctggtgctgcttgaatgtggttaaacattgacatagttttcctcttaatatgtgtttgcaaataggtggatttatacgaggatttataccttttggcaaggggcaagcggtgatttttagtaaattatttgcgaatagaatagaaatgtaaatattccaagctacgatattctttttacagtttgaacaagcagaaataaattagcacacaatcatcacttgaatgtgagataaattgctctataatgttgcacaaagtaacactgagagaggtagttatgcaagcgacattaagacaacaaggtggagccgctgtcttgactgtaccaatggcaatattgcaacaaatggggtggcaaattggtcataaagtcaatttggagacaaggggagaaagtgtcatactcacccctattaagcgtcaagcacgaggtcgtaagacagttgcagaattgttagcaggtattgatagtcaagaagttgcggagttgaatacaacagtggcagaattttcccaatctcaacccactgggaaagaagtatggtaatgcgtgttccgaaaaaaggagagatttggtatgttgatccgaatccaacgaaaggtcacgagcttcgctctcctcattattttattgtggtatcggacgaattattgaatcaagcattaggcacagcaatttgttgcccaatatctgcgggtggcaatgcggctcgttcgcagaatataactgttgtacttgatggtagtagtacagaatcaggtaaggtaacaggtgttattttatgtcaccaagtaagagccttagatttaaaagaacgccaagctaagtatgcgactaaagcagaggattatttaattgacgaagtcattatgaaattagttgacttaattgatccacaataaaacatctagggctattttacatatgtatttttatataattttatgttttaatacgctcaattttctcaacacaattaaggtgtaacaatgagctggattgaaaaaattttaggaaaaacgtcctcatcatcaagtggtaaatcaaaaattccagagggcgtttggacaaaatgtacaagttgtgagcaggttctttatagcgaggaacttaaacgcaatatgcaagtttgcccgaaatgcgatcatcatatgcgtattgatgcgcgtacacgtttattatcccttttagaccaagatactgcggaagaattagcggcagaacttgaaccacaagatgtgttgaagtttaaagatctcaaaaaatataaagatcgtttaagtgcggctcaaaagcaaacgggtgaaaaagactctttcatcgtaatgtatggcaagttgtatgatacgcctgtggttgttgcttcctttaactttgagtttatgggcggttcaatgggatctgtcgctggagcaaaatttgttcgtgcggcagaaaaagcattaagcgagaatattccgtttatctgtttctctgcgtcaggcggggctcgtatgcaggaagcattattttcattaatgcaaatggcgaaaaccagcgctgtattggcaaaaatgaaagaaaaaggcgtgccgtttatctctgttttaacagacccaaccttaggtggcgtatcggcaagtttggcaatgttaggcgatattaatattgcagagcctaaagccttgatcggttttgcaggcccacgtgtgattgaacaaactgtgcgtgagaaattgccagaaggcttccaacgaagtgagttcttaatggaaaaaggggcgattgatatgatcgtacaccgcaaagaaatgcgtgatacccttgctcgtttacttgcgaaaattactcatcagccgacgccatttaaaacgggcgaacttgttgcagaagaagtgtaatgaacgcattaatttcaccaaaagccacggattcattggaaacgtggctttcctatttagaaaaaagccatttcaaaccgattgatatgggcttggaacgtatccgaaaagtcgcggaagaattggatttactcaagccagccccttatgtgattaccgttgcaggtacaaacggcaaaggttcaacctgcaaattgctagaaattgcgttattaaaggcaggtctaaaggtcggagtttattcatcaccacacttaattcactataacgaacgtgtgcgtattcaaggacaagcggtcggaaatgctgatttaattgcaacttttgactatattgaacagcacaaatcagcctctttaacctattttgagttcggtactttagcagcgttagatctgttccgtaaggcaaaggttgatgtcgcgattttggaagtaggattaggtgggcgtttagatgccacaaacattgtcgatcctgattttgcggtaatcacttcgattgatattgaccacgttgagtttttaggcgataaccgtgaagcgataggtcgtgaaaaagcggggattttccgcccaaatattcctgtagttatcggcgagtctgattgcccccaaagtatcttagaccatgcaaaagagttgcaatgtcacgtttttagacgagatatagattggaaattttccgtcgaatctgaccgcttgcagtggcaatcgaaaaccaaatctttaattgttccactgcctaaaattccacagccaaactgtgccacagctttggcggttttaacccagttaccttttgaactcagtgatgaaattcttgttcaagcggtcgaagaggcgaagatgacagcgcgttttcaattattaggcgaacaagattttgcaactttttcacaaaatagaccgcttgcacaggtgattattgacgttggacataacccccacgcagcacgttatttatcggatcgtcttgcagaatgggttcaacctaaccgcaaaatatatgcagtgtttagtgcattggttgataaagatttatcgggtatcgttgagcctttggaagagttgattgacgaatggcattgtgctgggctacaaggttatcgagggcaacgtggcacagaggtaaaaagtaaattacttactgccttaccaaacgccaaagccgttgcctatgaaaatgttattgaagcaagccaagttctttttgaaacagcgaacgaacaagacattattcttgtgtttggttcatttcatactgttgcagattttgtgatgtggattgaacagtaggatatgaaaaacggtaagtttggcgacttaccgttctgttcatttactttttactagaatgttcagccattttacgtctaatttctcgacgctctttagaaagttcagcattacggatagcataatcatcaactcggttttcatagtcatctctcatgttacctatgattacacgtatgtcttggatagacatattgtcagtaatgtactgatttagattatcaagtaataaaatacgcttttgattatcacggattttgcgatcattatctgctgtttcacgtaataatttattttttaaacgataaagatgcacataatctagcatatcttgaaatgattgttttttgctattttccatctatagttcctctattttgataaaagattcctgttatgctagacgttttatactctatcgtcaaaaggtttatataaaaattttcaagaagttgctctaaatcaatcctaagtaaaggatattggataagaaaaatagcactgttatttaacagataatctatgctaaaatcggaagatcgaatattgagaaaatttaaatattgggagaaataaatgatgagtgcaaataaacgttctgttccgacgcttttttctactaaaacagatatttatagtcatcaagtgcgtatcgttttagctgaaaaaggcgttgcttatgaaattgaaaatattttaccaggcacaatttcggaagatttaattgaagtcaatcctagaggtactgtgccagtgttggttgatcgtgatctcatattatcaaatgcacgaatcattatggaatatcttgatgaacgatttcctcacccgccattaatgcctgtttatcctatactgagagctcaatgtcgtttaaatatacatcgtattcaaaatgattggttctctttaattgattttattgaacgtgatccaactacagctgaagctcaaagagcattaaatcagctacgcgaagaagtattagcattaggtccagtattttcagattctgattattttttgagtgaagattttagtctagttgattgctatgtagcccctttattgtggagaatgaatactctaggtgtagaatttaatggggcaggctcaaaagcggttaaagcatatatgaatagagtttttaaacgagatagctttgtgcaatctattggaggtagtacacccaaaaatttaatggatgataaagactgatatgaaacctttaagaccttatttataccaagcctattataattggattttagataatgaaaataccccatatttattaataaattcggagtacgtagatacagatgttccccaagaatttgtgcgtgatggtaaaattatcttaaatatttctccccgctctataggacaatatgttgttactgatgaagcaattagtttcaatgcaagatttcagggaattgctcgtggagtttatattccattcggtgctgtcgaggctatttatgcacaggaaaatggtgacggtgtaatgtttcaagaagaagctttctatcaagaagacacatatttagatagagtaaatagagcgcagtcactcaaaaaagttactaagaaaaaatcatctcatttaaagttggttaaatgagttatctgagggggaagtagtgcattcccccttctgtctagtttaaaaaacaaacgtttattatattatttccttatttcgattaaaattttcttgcaatagtatattaatttttatatccttctccgcactactttaatagtacattaatacatcaagttaaattaaggaaattcatatgaaattgagaaaaacaattcttttttctgcacttgctgctttcgcatttaatgcatctgcacaagataaaatccataatgttgcaattactgcaattgtagagcatcctgcattagatactattcgacagggtgttattgaagaactcgctagagaaggctttgttgatggaaaaaatattagtattaatttccaatctgctcaaggtagtacatcaactgcagctcaaattgcacgtaaatttgtaggagataaaacagatattattattcctatttcgacaccaagtgctcaacctgttgttgcagcaacacgttcaattcctattgtattttcaggtgtaacagatcctgtagctgccaagctgattaaatcttgggaaccaagtaaaacaaatgtaacgggtatttcagatcataaaccaattgaaccacaattggcactaatccaaaaactagtaccaaatattaaagctctcggatatgtttacagtgcaggagaggtaaattcagctgttgtgttagaagaattaaggaatgcaataagaggttctaatattgagattatgcctgtagctgtgcagcgtagtgcagatattggcacagctgctcgtagtttaagtggaaaggtgcaagctatttatattacagaagataatgctgtagtatctgcctatgaagcattacacaaagcagcacttgaagcaaaaattcctgttattgctgcggataaagacactgtaaaaagaggagctctagctgcttacgcagtgaatcaatatgatattggtgcagaaacaggtaaagttgcagcaaaaatcctcagaggtgaaaaagcaggtaatatcgcaacccagtctgtaagtaaaatggaattatccattaatcaaaaaacagcaagacaactgggactttcaataccagaatcattgcttcaagaggcaaaagaattattctaacagaggctgtatatcctaaagaataatatattgggctgtataactgacgtatttaaacggactgagtccagtagtaactggattcagtccttgaactagcagtttattttttactgagtcgcctgaattgccgttaatgcaatggtataaacaatatcatcaaccaaagcaccacgagataagtcattcacaggtttacgcataccttgtagcattggaccgatagacacgagatccgcagagcgttgaaccgctttataagttgtgttacctgtgttcaagtctgggaagacgaatacggtcgctttacctgcaacaggggagttaggcgctttagagcgagccacatcttccataattgccgcatcgtattgtaatggaccgtcaataataaggtctgggcgtttttctttcgcaatacgagttgcttcagctactttttctacgtctgcaccagcaccagaagttcctgttgagtaagaaatcattgcaacacgaggatcgataccgaatgattttgccgattcagccgattggatagctatttcggctaattgttcaggtgttggatctgggtttaccgcacagtcaccgtaaacaagtacttgatctggtaataacataaagaacacagatgaaataatagagttacctggtgctgttttgataatttgcattggtggacggattgtatttgcagtcgtgtgaactgcacctgaaactaagccatctacttcgtttgcttctaacatcattgtaccgagtacaacagtatctaacagctgttcacgagcaacaacctcagtcatacctttgtttttacgcaattcgactaaacgagctacatagttttcacgcacttcagctgggtcaataatggtaatgcctttgcctaaagtaaccccttgagcttcagcaacacgttgaacatcagcaggtggcgctaaaagtacacattctgcaatgccacgttccgcacagagtgcagccgctttaacggtacgaggctcatcaccttctggtaacacaatgcgttttttcgcttcacgcgcaagttcggttaattgataacggaatgcagcaggggagaggcgacgagcgcgaactgcacctttagaaataccttcaataaagtctgcatcaaattgttctgagacatattgtttaatcgcatcaatacgctctttatcatcaactggtacttcaaggctgaggctttgtaggcttaatgcagtttgccaagtgttgccttcaatacggaaaattggtaagccagtttcaaaggcttgttggcaaagtttggcaatttgagtatcaattttgtagccacccgttaagagtaacgcaccgatttccacgccattcattgctgctaaagatgctgcaacgataacatcaggacgatctgcagaagcaactaataaactgcccgctttaaagtgatcaaccatatgtggtaggcttcttgcacagaatgttacactacgaatacggcgtttatgtacttcaccttcattaataattgccgcacctaggtgttttacaagatcgattgcacgggttgcaattaaatctgatttccacgaaatacaagctagtaatttgattggaccagctttgaacagattttccatttcaagaatgttattgctgctgtgttggaacgagtcgaagatttcggttaaatctgggcgtgtacgacctgactcatcaacaggggcattaaatttgttgataaccacaccgagtaggttagggttgtggcgaccaccaaataaagaaactgcagcatcaatacgctctttaagctgtgccggtttgtctgctgccggtgctgcaactaacacgatttcagcgtctaatgcttgtgcaatttcatagttaatgctatttgcgtaagagtttttacgcgttggaattaagccttccacaataacaatatcactgtttttggtgagtttttgatgacgctcaaccactttttcaagtaatacatcggtttggttttttgcaatcaatgtttccgcttcacttagcataaatggtgtgcctgtttcggtactttgtgaaaggcggataatagtggttgaacggtcaagggtatcttcaccactaataggttgtgcgataggttttaagaaaccaacttttgcccctttttgttcaagagaatggactaaaccaagacttacactggttaaaccaacgccggtactgattggaattaaaataattgttctggacattgtttttttccttgttacaagcgggtagagtagtcaaatattttgcaaaatctcaccgcttttgtgatgtaaaaagtaaaaaacctgccatctggcaggttttagatattataacgctaagcacgctgtatcttgtgcaataacaagttcttcgtttgttgggataacgaatgcacggaatgcagaatcagcagcagtaatttcgcctgatttaccaaaacgtgctgccgtatttttctcgctatcaactttaataccgaacagttttaagtaatttaaggttaattcacgcactaggcctgcgttttcaccgataccaccagtaaatacgattgcatctaagtgatcgtcacctaaaacagccatataagcaccgatgtatttcgctaaacggtagcagaaaccgtccattgcacgttttgcatctgcgtgagttgcgtagttatcttctgcataacggcagtcgcttgtcacttccgttaaacctaataagccagattttttcactaatgtttcttcaatttcttttacagacatacctaacgtattgtgcataaagaaaatgattgcagggtctaagtcacctgaacgagtacccattactaaaccttctaatggagtgaaacccattgaagtatcaatacatttaccattacggattgcagcaactgaagcaccgttacctaagtgacaagtaatcacgttcacttttgacggttcaacacccacaactttagcgacttcacggctcacataatagtggcttgtaccgtggaaaccatagcgacgtacgccgtgttctttatataaagagtatggaagagcatagagataagcgtgttcaggcattgtttggtggaatgctgtatcaaataccgcaacgtttttctcttttaattcagggaatgctttgaatgcttcttcaataccgattaagtgagcagggttgtgaagtggtgcaaatgctgcagcttctttgatacctgcaaccacttcatctgtaataacgatagatgaagtatatttttcaccaccgtgaacgatacggtgaccgatagcaccaatgctgtcttttaattctgcacttaaaatgtttttcacgatatagttaagtgcttcactgtgagccgcacctgcacctaaatctgctgcacctttctcaccatttaatttccatttaatacgagcgtcaactaaattaaagttttcagctaaacctgataatttttcatcaccagaaacaggatcaaggatagcgaattttaaagatgagctaccacagttaagaataagaatattttttgacattgtcgaaacacctatgtgataagaaaaaattaacacgttttgggtaaacgtgactgcgtgcctatgatacgccttttacacttgaaaataaattgatctcagtaaaaaagggaagagaaaaaagaaagaaaagtcttaaatttatccgcttaaatttgttatttaacataatatacgttatgcgaacagaataggatataaccaattgatttataaggatattttcattttaacacttgtagcaatttgattttaaaggaaaatatccttatctaagattacttatcgtcagcaggaactaaaattacatcgccaacttgcaaatcaaagtatccgcttgttttaaatgattttggatgtacacttacctaagatactacgactcatggtactccttcatttagtaaaaatatagcaactttacatcacaaaacatttctctatgtttttatttacttagatcaatttctggcaataatttgttaccgaattgctctctccacccacacaataactcaggtaacttttgcctatcctgcccatttctataccatttaaacaactgatttaattgacgcttactcgccaacaactcaatcgccaaattttcaggacaaacttctgtaagacgcttttgcaagcgtttgaaagtagttttgtagccagcctcatcaaccaaacgacgaataacaggcggatagttctctggcaaaatttgcttaccctgctcgactaaccacaaaattttcttaccgtgaatacgcacttcatttgggtgcataaattccaacaatattgaagtatgtttcggttgtaatttagcaatttgtaacaaactctgctctttaataataaaatttaatgccaaatcacgtttttctgcttcttctatccgccacttagctaatatctgcaaaattgccagctcttgttggttaagttgccacgcattactgatctccttataggctttattcggatcttctacgatctgccgtttagctaacaaggttgcacactcttctacgacggcagtttgccacggtgtttttgccaaatcttccgccaatttgtgataaatcggcaacaaataccacacatctgcacaggcatattgaagttgtatctcactcaaaggatggctcaaccagtctgtacgggaagcccctttatccaattcaacctcaagataatgcaacgcaagtttggcaaagccaattgaaatacctatccccacaaacccagccattacctgtgtatctaacattggttgcggtaactgtttgaaatagtgttgaaaaacctccaaatcttcaccacaagcgtgaagcaccttaagcacattttcatttgctaacaacgccgtaaaaggggaaaaatccgtaatacttaacggatcaatcaaatacacctgcttaccatcaaaaagctgaattaaccccaacttcggataataagttcgagtacgaacaaactcagtatctaatgcaatcaccgattgttctgcaacctgcagacacatctgagccaaactaggattatcatcaacccactgatattctatatacttattcattttttctaatactttccacgagttagcgtaattttccaccatttattttaaaaaataaaataattttgtgacatcactctcataattgaaggaaacaatttgccagacacattataaaaatagcacaataaagtaacgacttagggagtaaaaagattgtaaggattatagctatgaaaatcacctcttcggattataaatatcaacatctcggcacggtttaccgtttagttgaacaatttgagctgatttctcgtactgacttagcgaaattatcaggatttgcccctgcatcaatgacagtgctgacgaaaatacttattgaccataaactgattttagagagaacctcacaaaatttgccgtctaggggcagacctgcagtggggctttctatctccccgttccactggcgttatctctgcttaacccttgcaccacaaaaactctctattgcactttgcgatctcagtggcacgctcatttaccaacaacattatagcctgacttccgacgaatatcttagcttagatcagcatatcctgcactgcatacaaactttttccctcaacacaccgcttaccaatgaagctttacttgccatttccatcagcgtagtggggaaaattgaccgcacaaaaacgattatcacgcaattagggcaacagcctctctcctgccctctggttgaaacattgcatcgtcactttaatcaaccgattttactcaacgaacattttcaactctggcttctagcggaagcaaccttaggaagtttaattgccaatgataacgttattttcttacagcttgatgatcaagtgaatttaagtgtattactcaaaggggcattacttcatcaagacgaacataaacgaatgaatgttgataaaatgataatgccaaaatttagtacatttagtgatgaaatcgctgaacaacggacagaaatcgaacgttatcaactcaccaatcaagtgactttccctgccctagccaacttgatcgaccgctattttgaccaccaacacacttgccttgaagataaaatcaactacttctgcgaacaagtagaagccgaaaaccctcaagcaatgcagattttatcgcatcttaccgacaaccttgcttatatgctgatgaacctaatcaacatattttctacggaaaaaattatgttgaactcatcgctattacgcattaaaaaaccactttttgaacaactgcaaaccaaactacagcaaaacttgcttcttaatgaactacgaattgatattgtcaccagccaatacgattgggacagccctctcattccttctattgcaattaaattaggcatttatgagggctgtttattaaaggggattgtagaggtgtaaaacgtagggtgggttttaaccaaccaattcaccaaaaataaaaggatgaataggatttgtgcggcgctgttttaattcccaaacatcataagcggcttgtaaacttagccataatctagccgaactgatccccgcttcttccaaagcaatagctaaatttgccgtcatcggagttttaccgtgtaatactcgagaaagtgtttcacgagaaaagcccaaatgttccgctaacgctttgattttaatattgttaggttcaataaatcctgttaataaaatttcccctgggtgagagggttttctttcgctcatattatctcctagtggtaatcttcataattcaaaacataagcatcgccgtcaataaattcaaaagtaatcctccagttgcgcgacacagtcattgaccaaatgccttccctatcgcctcttaatttatggcattgataaaaaggaagaaattcatcaacaacttttgcccgatctatcacatctaaaataccattgattttcttaatgtgatctatccgtagccctcgcgttataccttgtcggaaatattgctctagccccttatgtttaaaactcttaatcattacagctcccttcaaagagtgtgatataatcatatcacacaaaagataaaacactgtaataattattccctattcataataaagcaaaaggataaatttttattttttcgacgtagatcgaaaaaatgattttaaatgattgataattggataaaggacaaataagagtatatgagaacgccaaatgtggcgttcttgatttaacaattaacgacactgtgccttaaatcgcaatagatgatctaacaccacaattgccatcattgcttctgcaatcggcacggcacggataccaacgcaagggtcgtgtcgccctttggtgactacttcgacgggttcattatgtacattcacactttttccaggtacggtaatacttgaagtaggttttagggcaatatgagcgatgattggctgacctgagctaattccacctaaaatgccacctgagtggtttgagcagaaaccttctggggtcatttcgtcacgatgttcactacccttctgttcaacggctgcaaaaccatcgccaatttcaacacctttgactgcattgatcgacattaaggcgtgagctagatctgcgtccaagcggtcaaatacgggttcacctaaaccaactgggacattttctgcaatcacggttaattttgccccaatagagttaccctcttttttcagctctcggattaattcgtcaaattgttccactgccacaggatctgggcagaaaaacgggttactattaacttgttgccaatcaatctgttcgatatttgcaacagtttgtgggtcgattttgactgagcctatttgtgataagtagcctcgaatttctacgccaaactgctcttttaaatattttttcgctattgcccctgccgctacacgcattgcagtttctctggcagaagatcgtccgccaccacggtaatcacgaataccgtatttttgttggtaggtataatcggcgtgtcctgggcggaatttgtccattatatcgccgtaatctttggaacgttgatcgccatttttgatgattaagccgatacttgtacctgtggttttgccttcaaatacgcccgataagatttggacttcatcatcttctcgacggggtgtggtatagcgagaagtaccaggtttacggcgatctaaatcgggttgtaaatcggcttcactgagttccatattaggtggaacgccatctacaatacagcctaatgcaatgccgtgcgattctccgaatgtggtgactttaaaaagttgtccaatgctgttgcctgccatttgttttccttatttttattgttgggtataaaatcaataggttttaaaatggtgggctaaaaccccaccctacaaatctgatattccaaaaattgtttggggcaaatatgatttgcccctacaaatcatttgatgtcgctatttataccattttttaaatgcacttccatttgattgaaggtcattttaatttggtgttggttaaagagttctgtgatccgctgatagaggaaattgcgtgttgcggcacgatcgtctaattctggtacaaatacggtaaattcgtgttcgatccagccatcaccaaaactttgtaaattaatacttggcgatggttccaccattacttttggcgcttcgcttgcagcttggtttagcaagcgacgaaccagtgataaatctgcttcggtgctgattttcaaaataaactgtaagcgtgtgacggtgttattaaaggtccagttaataaatctatctgtcacaaaggcttggtttggtagtaccacttctttgttatcatcatcaatcaaagttgttgaacgtaggcgaatacggctgatcacccctgtaaaattgccaaccgttactttatcaccaacgcgaattgggcgttcaaataataagatcgtacccgatacgaaactaccgaaaatttcacgcaccccgaaaccaagacccacagataatgcggtgaaaatccactggattttgctccacgaaatgccaagagcggtaaaggcagaaatactaccgaaagtaaccatcagataggtcattaccgcagtgatcgtatgcggtgtccctttggatagtttaatccgtgagaagaaggtcacttctaaaatccctttcaggtttttcaccagcacataggtgacggtaatataaagtatcgaacgtaaaatattcaataaggtgatggactctaccactgtacctttagaggtagtttcgatgttttcccataaaatcacattattgagataataagcaatactgattaaatctgaccaaatcgcataaagcgatacgaataaaatcacccagccgattaaatcagctaaacggaaaatctgctcattaaccgttgaaatcttgatgatttcctctggtttctctctggcttcctctttagccccctgctctaaacgttctaaattttgttctctgattttttcccgttttttctgtaagcgacggtatgccattcgacgtgaagaaatagttaaagaacgataagcaaagtagcgtccaaatacccaaactaatgcgactaaataggtcgtaataatgtggtcgattaaataaactgccgtgtagtagtaacctaatacaatcagcacaatcaaggtaagcggtacgataaacagcacaaaacgcaagagtttaaacaggctgacactgcgttttttaccatcttccgttttagcattttcatactcttgaataccccgatctaatagagggcgtacaacaaaagtacacaaagctaaagcaactatcgtcacgacttgaccgatcacatcattagtaaacccgaccacctcaatttgagagaaaatcgaggaaactaagagcaacaccacaatccacacagactgcttaataatgcgttggaaaatttcgttacttgcttgtggcataccgaaatggcgataagctaacccatttggtcgcaatagtgataaaacggtagcaaaaaataaccaatattcaaaggcttcggttacccaagttgaagctaataatggatcaggcacaaataggtaaagtgccacagttgcaagggtcaaaaacatcaaaccgcttggtaaggctaatactatcgtccaaaacatcgcttctggtgtatgccaatggctatcattttttagggtattaacatggccaccaatggttgccaagcggtgttttatgtctgtttttttccaaataattaagccataaagggataacaaaatcgcaataaaagttagggttgaaggcaagttctgccccaaattttcaaagccaagatagtccgttaatgttgaaatctcagcaattgcttgttttggaaaggtttctaaccaagttaaatcaatcgggttattactttgaacccaaaaactttgttgttgtagctgattttgcaaggtatcactgatggtgataatctgcttttgtgtttgctcaatctcattagacaaattaagctgtatattaagcgttttaattaagtccgctaaaattttttcacgctcttttaagatgtctgttaaggttttgcgttccgcatcatcaaatagggttttgtgggtcgtttctaatttttcaataacgctattaaggttatagagttcatcacgtttttgcgataaatcaaaaatttctacccgtaaatttgcaatatctttggaaagccctttaattaagctatctgttggcaaagattgtttttgctgattaataatacgagatagcaccaaagtaccttgtaatgcactgatctgctcttcaatgtttcgctgggtttgtatcaaactgtctagtacatttttagcacgcaggctatcccgtgacaacgtattggttttttgtgtctgttcaaccaaaaattgacttaaatcggtgtttaatgaaagctcatcgtgaataatcggattttcaactttattgttagcttttagttcttcagcctgttttgcttgagcctcaaactcttttaaacgcttggcatttaagacttcctgtaacgttgcctgctgtttctgtaacaattgctgttttaacgttaattcattacgtttcgcctctttcaacgaaatcagcagatcaatgttttgtgctaaatattgattatatttattacttgcctctaggtattttaattccgcattgtatttatcaatcagcgatttacttgcttggttattgtgttttaaacgtgttaatttatccgcttgttgattattttcggtaatctgttttcgtgtttgttctgaggctgtacgataagttaccgcactagagtttgtttcattcaaggtcaattgaacattgtttaactcttgacgggtattgtctaaacgtttttctaactcttcattactgagtttactggaaatttcaacttcactgtttaactccttagttaatttgtcgatatttttcttataagtatctaaagttgcagttgcattagtaagttttttttctaaagcctctaattcactattttgatttttagttttctcaatgaatagcaaggcttcttcaatgtttttgaccggttcagttgtttgctcagaaggattggtttttattgcttctaactgcgttttcaaatcttccgcagacacaaaatcttccaccgcagactgaaccgtcgccgtgaaaaaagataaacataacgcaagccaaaatgattttttacacatttttttctctcaacttgttggcgatatacgcttttaaatgggttctagacatcttaatgccatttgattgccctatctcatcttccaaagggaaataagcaatcggctgtttgaatttttctaatcgttgcattgcaaaagatttcaacagattgaccgcttgtattgaaaaaggttcgctaaaagccactaacgccacaggacgttcgccaaattcttgatcggcaactggcacaacaaacacttgttttacaagcggatatttttgtagcaccttttccacttcttcgggctgaatattttccccgcccgaaataaacatattatctaatcgccctagcacttccaatttgccattattccaacgccctttatcttttgtcgcaaaccagccttgagcattgtgtaaggcaacaattttaccttgttgccaatagcctaacgcaaggctctgcccttttacccaaatttccccctctacgagggtagcttctcgatttgctaacggtttgccaacattatcactctcatttttaacagcacaaatggtcgatgccatttctgtcattccatagcctgcataagttgtgatctgatgctgttgagcttgttcaattaaatctgccggaattgccgagccacctaataaaatatgctgtgatactaacttttcaccaagccaagctaaataacgctgtaattgtgttggtactaaagaagcgtggctgacttgcgataacatttgccaaaattccgctttatcttccgtcagataaaggattgccccttgcgataaccaacgccaaacaatcccctgccccgaaacgtgaaaaagaggcaaacttaacaaccaagaacaatggcgatcaaattgaacaaaatcacagacactgattgcattggcaagatgttgagcaatagaatgcactaccgctttgggattgcctgatgaacctgacgtaagggtaaaagtggctggtttatcgaaagaaaataagccattgtcttgatttctagataactgaaaacccctatctagagaataaaaatcctgatcggtcagcaaaatagatacttggttttgttgcaatatctgttggcgttggatctcgctcattgcaggattaagcgttaagatctttctgccacttgccaacacagcacaataacagagcaaaccgattaaacggtgagaacctgaataagccaccaaactattcggcaatgctaactgctcaagcaatctcaccgcttgttcaatcaacagttgcaactgttgccacgaaatttgacggggtaagtaagaaaacaaggtagcatttcctctatcccaaacaatagcaatatcttgagcctgtttttctgcccaatatattgtggggaatgtcggaaatactacccttgacataaattaattgaattgagctttaatacgagcaactaactcttcaggtaattccattgcattcattaatgcacacaaaataatcccttttcgttccgtattattattcgtaatcacccaaaatggcgactctggaatttgcttcgctttaacgctcgaacccgtcgcaagaatagtttgttcatcacgagcaaaataaattcgctcactgccctgcacattttccgtcgcatgagaaaagccctcaggatctgctttatacaaggcagacaacaagtgtaaaaagcgatttacgccttttttttcattgttaaaaaggctcgaagccaacacaaattcaacttgcttaatcaccttatcttgttgatggagttgtttcttttgcttaggcagctttgcaagatctttcaattcattgatcatattctcttgcacaagtacaaaaggttggggagatgctggtaaacggagtaaacgacgtaaaatatctgacgcactttccccaatagcctgagttctgcttgcaatatagtggtataattcatcatcaacttcgattgttttcatcttgtcccctaaataacttgattactggaaaattctaggcattatacgcatttccgatctttttaacaggatctaaacacgataattgaataaattttaattaaattatggcggaaaaaatgtttcttcatcaccaatttcaaacagcaaccaacccagcgacttcatcaccacaaacaatggtctttattcacggtttatttggtgatatgaataacttaggcgtgattgccagagcctttgcggaacagtttaatctactccgcatcgacttacgcaatcacgggcaatctttccacagtgatgaaatgaactataccttaatggcagaagatctgcgagatctactcgaccacttacaacttaacaatgttattctcgttgggcattcaatgggaggaaaaacagcaatgatgttagccaacatcgcccctgagcttgtggcaaaactaatcatcattgacattgcccccgttgcttatcacctcaaccgccacgacgacatttttgcaggactttttgcggttaaagctaccaaaccagctaaccgccaagaggccaaaacagcaattgcaaaaggtattcaagatgaaggcatacaacaatttatgctgaaatcattcgatccacaaagcccagaattctttaaatttaatctatcgggtttaaaacaaaactaccccaatctaatggattggcaaaatgtttttgtggataaacctactctctttatcaaaggggcgttatcggattacttacaagaaaaagacacccaaaccatcttagctcaattcccacaagcaaaatcctttattgttagcggtgcagaccattgggttcacgcagaaaaaccagaagctgtggtcagggcgatggttaagtttatataaaaatgctcctaatttactaaaaatcaaagggggtgactgctttctaatccagtctcccccttacttctcatcaaataataccaaagtgtttttcggacaattctaaatgagtagtcaactgagcaaaaatgatgtcattaccgccagtgaccctatcccaaattctgagaagctttttcttttccaccttgacttattgctgctacaaccgctccaacacctaaaatccctccaccgagataagctaaattagaaataacactactactctgagcagcaacatctgacaccaaagttgtattttcaactacttccgtagaggatacagaagattcattcttttttacttcatcaatatctgtagattctgaagtggtgacattttcttctactttttctgtatttgaatcaatataatcttctattgatttttgttttatatttttctttaattgtgttcgacgagctttggttgagaatatctcttctttatcaaaaatagcttgaacatctcgcatgtgcaacactttactaattaagtagacagttctctacaaataagagagaattgtcaagataagctcttttatttttcaatagtatttatattccaatgaccactgaaatcaattacgaaggcgttgaacaaatgccgattaagcgttttacggaagacgcttatctcaattactcaatgtatgtcattatggatcgtgctttgccttttattggcgacggtctaaaacctgtgcaacgtcgtattatttatgcgatgtctgagcttggcttaaatgctgcagcaaaatataaaaaatctgcacgtactgtcggtgatgtgctaggtaaatttcacccgcacggtgatagtgcctgttatgaagcaatggttttgatggcacagccgttctcttatcgctatccattaattgatggacaaggaaactggggagcgccagacgatcctaaatcctttgctgcaatgcgttataccgaatcaaaactctccaaaatggctgaaattctattaggagaattagggcagggtaccgttgattatcagccaaactttgatggttcattagaagagcctaaatatcttccagctcgtttacctcatattttgttaaatggcacaacaggtattgctgttggtatggcgacagatattccgcctcataatattaacgagttagcggcagcttcagtaaaattattggataatccaaccgctagtcttagcgatattttggacgtggttcaaggccctgattacccaacagaagctgaaattattacaccgcgctcagaaattgcaaagatttatgagcaaggtagaggctctattaaaatgcgagcggtatggaaacgagaagagaataatattgttatcaatgccttacctcaccaagcctcgccatctaaggtgattgaacagatcgcaacacaaatgcgaaataaaaaattgccgatggttgatgatattcgagatgaatctgatcacgaaaaccctatccgcattgtgctagaaccacgttctaaccgtattgattatgatggcttaatggatcatctgtttgctaccactgatcttgaaaaaagctaccgtatcaatatgaatatgatcgggcttgatggtaaacctgcggtgaaaaatttgctgaccattcttactgagtggttagcattccgtagaacaacggtcacacgtcgtttaaatttccgcttggataaaatcatcagccgtttacatattttagagggcttgatgattgccttccttaatattgatgaagtgattgagattattcgcaatgaagataatcccaaagatgaattaattgcacgttttcaattaagcgatgagcaagccgaagccattctaaacttacgattacgtcatttggcaaaactggaagaacacgagttaaaagcagaacagcagaaacttgaagaagaacgggaacatttgcaagggatcttaggttcagagcgtcgtttaaataacttgattaagaaagagattgaagccgatgccaaagcctttgccagccctcgccgctcaccacttgtggagcgtgctgaagcgaaagcgatttcagaaagcgatttaacaccaacagagcctgtgacggtaattctttccgaaaaaggctgggtacgttgtgctaaaggacacgatattgatgtgcagaacctaagttacaaagctggcgatagctaccttgcccacgcttatggtaagagcaatcagccagttgtctttattgacagcacagggcgtagctatgctcttgatcctcttagcctgccttccgctcgttcgcaaggtgaacctattacgggcaaaatcagtttacctgatggggcaacggtgcaatgtgtgctaatggctgaggaaagtcgtaaggtactaatggcttcggattcgggctatggctttatttgccaatttgaagatctggtttctcgcaacaaggcagggaaagcggttatttccttaacggaaaatgcaaaagtgctaccaccgcagttgttaaaagagggggaagaaaatctgttagtggcaatgagcaatacagggcgagtattagtcttcccagtttctgaattgcctgagttatctaaaggcaagggaaataagatcatcaacatttctgcacaagctgcgaaagaacgagcagagctactttctcgattacttataatcaacccaacaagttcgctggttttcgtttcaggtaaacgtaaaattacgctaaaaccaacagatattgaacattatcgtggcgaacgagcaagaaaaggcacgcaacttcgagggctaagtggtaatgttgaagttgaaattgtagattaggattggggggaatggtattccccttaatacattctagagaatacccaccacctgacttaccacatttccctgtgctaaacgagtgactatcgtttcaccgattgcaatatcctgagtggatagcagtgctttgccttgttggttttgtgttacggagtagcctcttgctaaaatagcaagcgggcttaagccgtctaactgcgtgcaaagggtttgaaattgctggcgacgttggatgatattcttctcaatggcatagcttaaacgttgctctagcttgtgcaaatgttgtgtttgggctgaaatacggtaaggaagcggatttcgttccattcgttgtagtgtatttttccaacactgttgtttacgcaacaatagctgttccatctgctgtttcagctgtttttctaagtgcgaaagctgttggacacgttgctgtaattgacgctgtgggtgttgagcctgcaaacgaagttgcaagcggtcaaatcgggctaatttttcactccataagcgatcaaaagctaaattcactttatcagcgtgatgttgtaactgtcgtaacaactcttgttgatcacggctgaccaactctgccgcagccgacggcgttggcgcacgcaaatctgccacaaaatctgcaatagttacatcggtttcgtgtccaacggcactgataatcgggatctgagaatgataaatcgcccaagcgaccgcttcttcattaaagcaccataaatcttccaatgagccaccgccacgcccaacaatcagcacatcacattcctgacggcggttcgccagctcgatcatctgcacaatatcagctgtcgcttctttgccttgcactaaggtcggataaatcacaatttcaagagttgggtcgcgacgttgtaaaatatgcaaaatatcttgcaacgccgcaccacttgatgaagttacaatgccaacacgtttaacgaacgtaggaataggctttttatgttcttgagcaaataaccctaacccagccaatttcattttaagctgttcaaattgctgttgtaacaagccatcgccagcaggttgcattgtttcaataataacttgataatcacctcgtggctcatacaggctaacattcgctctcaccaatacttgcattccattttgcggacggaaattcactcgcatatttttcatacgaaacattgcacaacgcacctgcgcttgttcgtctttcagggttaaataccaatgcccagaaacaggttgcgaaaagtttgaaatctcgccgataagccaaacactgccaaattcgacttcaagcatctgtttaacggagtaattgagctgactgatggttaggatatggtttttcataataaaatttaaaggattcaatatgttatcctcaaataaattatccccttgtcaatattgtaactaaaacaaataatgacaagaggataacacaacaaatctctttgttaattttatggataaacaggtagacgtttacaaatatccaaaactttcactttagtcgcttcaattaccgcagcttcgttatccttaccgatgttatctaatacatcgcacatccaacctgcaagttcccgtacttcagcctctttaaaaccacgacgagttacagatggagtaccaacacgaataccagaagtaatgaatggtttttgtggatcgttcggtactgcatttttattaacagtaatatttgctttacctaaagctgcatctgccgctttacccgttaaaccgtggctcactaaatcaacaaggaataagtggttttctgtaccatttgaaacaacgttatagccacgttgtttaaatacttccaccatggcttttgcatttttcaccacttgttgttgataagctttatattcagattctaacgcttctttaaagcaaaccgctttggcagctattacatgaactaatgggccaccttgactagcagggaaaactgcactttgtagtttttggtataactcttcatcttttgcacttgaaagaattaaaccaccacgagggccacctaaagttttatgtgtagttgttgttacaatatgagcatgaggtaatgggcttggataaacgcctgcagcaattaatcctgcaacatgagccatatcgacaaataaataagcccctacttcatcagcaatttcacgcatttttgcccaatcaactacttgtgaataggcagagaaaccgccaacaatcattttaggcttaacttcgtgagcttgcttacgaagagcatcataatcaataacgccttctgatgtaataccgtattgttcggcatgatagatttttccagagaaactaacagatgcgccatgagttaagtgaccaccgtgagccaaactcatccctaaaatagtatcacctggatttaatagagccatatacacagctgcatttgcttgagaaccagagtgcggctgtacgttcacataatctgcattgaataactcttttgcacgttcaatcgctaactgctctacaatatctgcatattcacagccgccataataacgtttaccaggataaccttctgcgtatttgttggtaaattgtgaaccctgagcttccatcacacgaggacttgcatagttttcagaagcaataagttcaatatgctcttcttgacgacgattttcgccttgaatagcttgccataattctggatcataatctgcgatattcatatcacgtcttaacattggtttctcctataagtaatcgtttgcgtaattgatctatccatattctacgcagtttttttgactttagatagcagttttttctgatgattgtaataaaaatatcaagaagcaaactaaaactaagactgaatgccttgaaattttctgacaagctcaccccagaaaatcaaggaatttctacccttttacacgaaaccatgcatgcgttagcattaaaacacccttttgttagagggtaaatggtgttattcgtttgcacagccataaattcttcccccgcttgcgggggaaggtgcccgaagggcggatggggggaaagatgcaagtaaatcccgcacctactctaccctgccaatgtcgccaccatcaccgctttaatcgtatgcatacgattttctgcttcatcaaaaacaatagaggcttcggattcaaatacttcatccgttacttctaatccgttcattccatatttttctgcaatttctttacccacaagggtttggtcatcgtggaaagcgggtagacaatgtaagaattttacatttggattacccgttaatttcatcaattcagcattcacttgataaggcttcattaaattgatacgagattcccaagcggattctggttcgcccattgatacccaaacgtccgtatagacgaaatcaacatctttaaccccttctacaacatcttctgtacaggtaattttcgcccctgttttcgtagccatttctgcgacttcgtctaataatgtttgttcaggaaagaactgtttaggagcaactaaacgtaaatctacccccattaatgcagccccctcaacaaaggaatttcccatattgttacgcgcatcacctaaataagcgagcttaatttgattgagtggcttatttgaatgttcgatcatcgtaaggaaatcggcaagaatttgagttgggtgaaattcatcggttaaaccgttccaaacaggtacacctgaataatctgctaatgtttgaactaacacttgtccataaccacggtattgaataccgtcatacattctacccagtacacgagcagtatctttcattgactctttatgtccaatctgcgatccactaggtccaatataactcacattcgccccttgatcgaaagcagccacttcaaaggcacaacgtgtgcgagttgagcttttttcaaagatcaatgcgatatttttgccttgcattgttgggacttctcgacctgcttttttgtctgcttttaattttgcagataaatctagcaggtattgaatttcatttggggtgaaatccattagacgtaaaaaatggcgatttttaagattgatggtgtttgctgacatcataattttcctgatttgaaataaataaggcttttattataaatcctttcaataagagaacaatgggaatttgtggggaatgtatcttattgctttacatcttatctctttttttgtatagtttggcgatacaatcaggaggtcaaatgattatttcatttaagcataaaggattgaaattattttttgaaacaggatcaaccgcaggtattcaagcaaatcacgctagtaaacttgcttttcaattagccactctaaaccaagcaaaaagtgctttagatatgaatgcacctagctggaatttacatcaattacaaggtaatttagctgggcattggtctatcaaggtaagtggaaattggcgtttaacttttaaatttcaaaatggtcacgctgaagtcgtggactatcaagattatcattaaggagctatcaatgaaaatgtacaatccagctcacccagggcttattttaagagaatatattgaaggatataatgtcacagaagtggctaaacgtttaggtgtcactcgtgtcacgctctctcgtattttaaatggcaaagccgcaatttcacctgaaatggctcttagattaagccaattattaaaaactagcccagaattatggcttggtttacaatcccaatacgatctttggcagcttgaacaacgcccaagttttaatattcagccgttatttgcatagcacttgttgtatgttgcaacgttctgctcaaaatttaccgcttgttgcttataggagaacataatgtctaaacaccttactgaacaacgttttattgattttccgattcacgacagtgtcttggctgctcttgatagcaaaggctttgaattttgtacacccattcaagcgaaaacgttaccttatacgctgatcagacaagatattgcagggcaagcccaaacaggaacagggaaaacccttgcattcctcgttgcgacctttcatcatctattaaatcacgatattccaaccaaacataatcaacctcgtgctttaattcttgcaccaacccgtgaacttgcggtacaaattgcctctgatgcatcaattttaacgcagtatgcggatctgcgtttagctcttgcctatggtggtgacggctacgacaaacagctaaaagagattgagcgtggagttgatattttaatcggcacaacaggacgggtgattgattatgtcaaacaaggcattattgatctcgataaaattcaagtcgtggtgttagatgaagcggatcgaatgttcgatctcggttttatcaaagatattcgctatttaatgcgaaaatgtccgaaacccgaagagcgtttcacaatgttgttctctgcaacgctctctcatcgtgtgcgtgaactggcatttgaagatatgcacaatgcagaatatgtggaaattgagccactacaacgcacagggcatcggattaaagaggaactgttctacccttctaatgaagataaaatggcattacttctaacattaatggaagaagagtggcctgatcgttgcattgtgtttgccaatactaaacataaatgcgaagaaatttggagctacctcagtgcagacggacatcgagttggcttgctaacaggcgatataccacagaaaaaacgcttggcattattggatagctttacgcaaggggaattagatattttggtggcaacagatgtagctgctcgaggtttacatattcctgatgtgacacacgtctttaactatgatttaccagacgaccgtgaggattatgttcaccgtataggcagaacaggacgagcaggggaaagtggcgtatctatcagctttgcttgtgaacgttatgccgttaatctacctgcaattgaagaatatatcggacacgctatccctgttagtcaatacgatagtgaagtgcttttagcattgccaaagccacaaaaagccaaaacaagaacaccacaaggcaagaaatataaataaggagaaaaaatgaattacaccattgcacacagcaagtcaggcaatcccatttctttaacagccaagatggcaaaccgccacggtttaattgcaggagcaacaggaacagggaaaactgttacattgcgaaaacttgctgaaacttttagcaatgatggcgttcccgtattcctagttgatgtcaaaggtgacttatccggcttagtgcaagcgggaagttatcaaggaaaaattgcagaacgtatcgatcaatttggactgggtggtgaagcatatttaaacggatttccagtttctttctgggacgtatttggcgaagtggttgaaggagaaggggttggattgatttttatgtagcaattacacaaacatttcatcgtaggggcaaatcacatttgccccaaaatctccttcaaaaacctcctcaaactcaagcactgcactccctcaaaggtattaccctcaaattcatccatcgtcaccacatatttggggtagttgtcttggattttgagcaagttgccaaattctcgttcgagcgttttttcttcgttaatcgtgagtgtggcttgcacataaatgcgttcgccatttttctctgctacaaagtcaatttcttggctatttaaaccaccgattttgacatcgtaacctgcgatttgaagatgattaaaaatgcagttttcgagcaatttgccacggtcttgcactcgatagccaatcagggcgtttcgcaaacctaaatcttcaaaatagtatttttcgccaatctcaaaaatccgtttaccttcaatatcatagcgtggcactttgtggatcaaaaaggcattggcaaggtattccgcataattttgcacctgcgtgcttgaagtagtaattttctgtgattttaaaaaatcagagatttttttggcggaaaacagattgccgatattgcttgctaaaaattgcgtaagttgctctaaaaattgcacatttcgtaacgcatagcggttcacaatatcccgaatcgcaatggtggaataaatattgcgtaaatactcaaatacgatattgtcttgcaagggcaagtctttcaaataaggcagaccgccgtatttcaaaaacagcgacattgatttatcgctatcgtccagtttcataaattcaagaaattcaaaataggaaagggagtggacattaatttcaatggcccgcccactcaggctgcccgcaatatcacgtgaaagcaaatgagcattactgcccgtgcaatacaaatccaattcatcatctaataaaagcgaacgcaatgcttgttcaaaatctgtaatttcttgaatttcatcgataaaaatgtaatttttttgaccgctctttttctgctcctgcacaaaatcatttaggttttcagcggttgtaatgtggctaaatgccaagtcttctttgttgatataaataatgtgggcattttcatccgccgtttgaatctcttgcataatctgaaacagcaaataacttttccccacacggcgctgcccagtgaacacttttattagacgttttcccataaacggacgcaccgtttcaaggtatttctgacgataaactaaatctttcttcacactaccccctttcatttataattaatactttactcttaaataaataaagtttcaattataattgaaactaatttcaaatacgtgcagaattccaattacaaaataacctagttaaatcatcttaatgttttcagggggattaaagcagtcctagctataataaaaaacccagcaaactgctgggctttcatctctaatataatattttagaacggaatatcatcatcaaaattatccattggcggttccgcttgcggtgctggttttgctggtgcttttgcggtttgtggttgagcattgccaaagttattttgtgcgtaattatcgttgttgtagccttgattatagttttgcggagcaggtgcttggttccagccaccaccttgatttccgccaaaatcaccgccactgctacggctatctagcatttggagtacatcgccttgaatttctgtggtgtaacgatcttgaccgttttgatcttgccatttgcgtgttttgagcttgccttctacataaacttttgaacctttgcgtaagtattgtcctgcgacttctgcttgacggcggaagaaaacgatacggtgccattcggtgacctcacggcgttcgcctgtcattttatcgttccaactttcactggttgctacgcttaatgttgcaaccgcatcgccgtttggcattgtacgcatatcagggtcattaccgagattgccgacaataattactttatttacacctgccatatcaaatcctcttaaataaattgtgttggttaaatgtagttttgcgtagggacacactgcgtgtgtccgaaactatatgtttgtatttatcggggacacacgcagtgtgtccctacctcattagttcaaaaataatagttatgtatttttgtacataatattgtaaaacattaaaagctattttgcctgaaaataaaaaaaaatcatctactaaaactgatattttgtacagttaatcaatttatgcgataataatcgaaaattcggaaatttttgctttacatttgtttagaaggcagttatgcaacatattgatattcgtggggcgagaacccacaatttaaaaaacgtgaatttggttcttccgagagataaatttattgtgattacagggttgtcagggtcaggcaaatcgtctttggcttttgatactctttatgctgaagggcaacgtcgttatgtggaaagtttatccgcttatgctcgtcagttcttgtctttaatggaaaagcctgatgtcgatcacattgaagggctttcccctgcgatttcaattgagcagaaatctacctcacacaatcctcgttctacggtagggacggtgacggaaatccacgattatttgcgtttgttgtttgcccgtgtgggcgagcctcgctgtcctgatcacgatgtgccgttagcggctcagacaatttcgcaaatggtggatagagtgctggaagaacctgaaggtaagcgtttgatgttgctttctcctgtggtgaaagatcgtaaaggtgaacacgcaaaattattagaaaatctgaccgctaatggttatatccgtgccagaattgatggggaaatttgtgatctgtccgatccgccaaaacttgaattgcagaaaaaacatacgattgaagtggtgattgatcgttttaaagtgcgtagcgatattgcgacccgtttagcggagtcctttgaaacggcattggaactttctggctcaacggcgattattgccgatatggacgatccaaatgcggaagagttagtgttttcgtcaagttttgcttgctctcattgtggctattcgctgacggaactagaaccacgtcttttctcgtttaataatccggccggagcttgcccaacttgtgatggtttgggagttcagcaatattttgatgaacgtaaagtggtgcaaaaccctgatgtgtctttagcaagcggtgcgattaagggttgggatcgccgtagtttctactatttcggtttgttgaaatcggtggcgaaacattatgattttgatattgaaatgccgtttaatcagttaccgaagaaaattcaaaacatcattttaaatggttcaaaagatgaaattgaatttgtctatgtgaatgatcggggtgatagcgttaagcgagttcacacttttgaaggggtgctgaataatatggctcgtcggtataaggaaaccgagtcaaatgcagtgcgtgaagagctggctaaatatattaataatcgtgtttgtaccgattgtgaaggctctcgtttacgtcgtgaagcccgttatgtctttttagagaaaaccaacttgccgatggtgtcggaaaaaagtatcggcgaagccttagaattttttgaaggcttacatctatctgggcagaaagcacaaattgcggaaaaaattctcaaagagatccgtgagcgtttgtctttccttgtcaatgttgggttgaactacctttcgctctctcgttcggcagaaaccttatcaggcggtgaagcccaacgtattcgccttgccagccaaatcggtgctgggttagtgggggtgatgtatgtgcttgatgaaccgtctattggcttgcatcagcgagataacgaacgtttattgaacactcttattcatcttcggaatttgggtaataccgtgattgtggttgaacacgatgaagatgcgattatggcggcggatcatattgtcgatattggaccaggggcaggggtacacggtgggcagattattgctcagggtacggctcaagaaattatgcaaaatgaagcatcaattacgggcaaattcttatcgggtaaggaaaaaatcgagatcccgaaacagcgtaccccacgagatgaaagcaaacagctggtgttaaaaggagcaagcggtaataacttaaaagaagtcgatttagctattcctgttggcttgtttacttgtattacaggggtatcggggtcgggcaaatctaccttaattaacgacaccttattcccgattgctcaaaatgcgttaaatcgtgcagaaaacagcgatgtcgccccttataagagcattgatggcttggcacattttgacaaagtaatcgacatcaatcaaagtccgattggacgtacgccacgttcaaaccctgcgacttatacaggtttatttaccccgattcgtgaactctttgctggtacacaagaagcaagagcaaggggctatacggtcggacgtttcagctttaacgttcgtggcggacgttgtgaagcctgccaaggtgacggggtgatcaaagttgaaatgcacttcttacctgatgtatatgtgccgtgcgaccactgtaaaggcaaacgctataaccgtgaaacccttgaaattcgctataaaggcaaaaccattcatcaagtgttagatatgactgtggaagaagctcgtgagttttttgatgccgtgccgatgattgcacgtaagctacaaactttaatagacgtaggcttatcctatatccgtttagggcaatcttctaccaccctgtcaggtggcgaagctcagcgggtgaaactggcagcggaattatccaaacgtgacacgggcaaaaccctctatattcttgatgagccaacgacaggattacacttcgccgacattaaacaattattgaccgtattgcaccgcttgcgtgatcaaggaaataccattgtggtgatcgagcataacttagatgtgatcaaaacggcagactggattgtcgatttaggcccagaaggcggtagcggcggcggacagattatcgccgaaggtacgcctgaagaggtggcaaaagataagaaatcccatacggcaagatttttaaaagagattttgaagaaaggttaagttgtagttgcaagcggtcacttcgttataatattttgcaaaaaaccaaacgaatccgaccgcttgtttgaaaggagaaaatgatggaataccaatttacacataccatgcacggcgttattgccaaatgttcaatggatcacgaggcatttgctcgttggttaaataccgagattgtgccaaatccaaaagagttaaccgccatttttgccgaaattgagcattgtcgccaaaccaaagatcaaaaccacgaatggatttttgaaggtaaagaatatagcctttatatcaacattgaagaagtgatggtgaaagcaaataatctggatatgacatttgaagaaatcgaagatgtcgaaaacggctttagtttctatgatgaagaaagtatcgctttttgtggattagaagattttgaaatgtttttgaatgcctatcaaaaatttattcaaacctaccactaaacccacttttgaaaaatttggcacgccacaaaccgcttgggaattacagcaacatcaatgtttgctctatgaaagccaaactttatggcaatttaatgaaaacggtcatcaaattaaattaaaaccccaaagccaagtttatagcaacaatggctatgcgttggtgcaaatggcaagagcaggtcagcttatgcaagaacagaaaatacacctctaacagacttaaccagcaccatcctattaaaaatcacacaaagaatcaaaggctgccatcaatacacttgaaggcagcctttattattaatatttactcagatatttaatatcttaccactgtaatgcaatacctgcaccagcattgtatttgccttgcgaagttgcacctgcagaaactttaagaatcacacgaccattatcagacattcttgagaatccaacagcaactgcattttgtccctcgaaagtaccaataccagcacccaatgtgcttttacctggtaaagtcacttgtggaatattgctcatagccgttgttgcagcaatacccgcacgaagttgacgcccttctctctctaacttcgcacccaatctatgtgcaacattatacaactggctaccattaatcgcatcggttgaagtagaagaaatttcccctgttgcaacattttggatacggcgctcatcacctgcagcacctacggaaaccacaccgtttgcggttgcaccagcgaagccatcataaatcatgttacccaccgttacacttgatactgtaccagtcgatcctgctgtagtcgttgaacctctagaaccatcttgtttccagtttttgagagagcctgtttgactaccatcaccagctgtagccgtcgtattgttacctaaataaacggaattctcaaccgtcccttcaggagttgcagacatccaagttaatgcaccattactatcacgcttattattcacattattaccaagaacaaaggtattgcttgatgtaattacattatcattaccgaatgcatagcttccatcaatgcctttatagattggattacctgcactgtcagtaccaatttgaacaccacgaatgatattcgggtcaccaaacgcacctgatttattcgcaattacttggttaccagtaccgatagcaattgagtttttacccgatgcggttgcacctttacctatagctaatgcattatcacctgccgcaacagctttataacctatagctgttgcataagtacctgaagcacttgagtcaatatcgttagatgcttggttaataggctctgctacaccatcatttgtatggaagaacttgataccttgttcgttcatattatgaatcgcagtaatcacagagtttgtaacaaactcagtttgacctttcacgttgtaagtggtaagtgtgtactctttagcttgtacaatctcgttaccatcagcatccaattcaggattgccattcttatcgcgtttaacttcagtaatgactgaaccatctttgtccttagcataggttactgtagaaccatcttttttctgttcaacttggttaccattggttaaagcgtaaacttggcgaccattcactgcatcagtactattcggtgaaatatcaccatcagcaataccactcaatttcacacgaggatcaactttctctttatatttctggagattgccatccttatcataaataggttgtttggtcactggatcccatttaacaaactcttcctcgactttctctcctgcaccagtaaggttgattgtattcttatcaccagtcattgtcgcagtgcctaaagtcacagaatttaagttcgttaaatccttagcacctgtaggaccttgtggacccactggaccttgctctcctttaggaccttctgggcctgtatcgcctttcggacctgttggacccgcaggacctgtcggaccaactggaccctcaggacctgttgcaccagcagggccctgaggacctgctggaccagcttcacctcttggtccttgatcaccctgttcacctttatcacccttaggtcctgctggacctataggacctggttcacccttagcacctgcaggaccttgtggacccattggaccaacttcacctctatcgcccttaggaccagctactcctggaatcccttgttcacctctaggaccttgtggacccgcaggaccgcgctcgcctcgctctcccgcaggacctgttgcacccgcaggacctcgctctcccggtggaccttgatcacccttagcacctgctggacctgcttcacctttcggacccgcttcacctgttggtcctcgatcaccctgttcacctttgtcacctttaagacccttttcacctctagggcctgctggaccttgctcacctgcaggacctggttcacccttttcacctctaggaccttgtggaccctcagaaccgcgctcacctcgctctcccgcaggacctggatcacccttagcaccttgtggacctgctggaccaactgcacccgcaggacctgctggacctgctggacctggtacaccttgtggtcctgttggacccactggtcctcgctcaccctgttcacctttaggacccttttcacctctaggacctgctggacctactggacccggaggacccgcgggaccagcatcccctttcggaccttgcagaccagcatcccctttctgacctggatcacctttaggacccctaggtcctgctggacctgtttgtcctgttgcacccgcaggaccaactggaccctctttcccttgcggtccttgtggacccattggacctggtactcctggttctcctcgttcacctctaggacctgtttcaccagcagggccccgaggaccaactggacccgcaggaccagcatcccctttcagaccttgctcacctgcaggacccgcagggccccgaggaccaactggacccactgggcccgcaggacctgttggacccattgcacctgctggaccttgatcacccttagcacctgcaggacctgctggacctgctgcaccttgtagtcctgtttctcctcgctcacccctagcacctgcaggaccttgttcaccccgaggacccgcaggacccatcggaccttgcggacctgttggacccgctggaccttgatcacccttagcacctgcaggaccttgttcaccccgagcccctgctggaccaactggacccgcaggacctgctggaccagtttcaccttttagtccctgatcaccctgttcacctttgtcacctttaagaccattttcacctctagggcctgctggaccttgctcacctgcaggaccccgaggacctgctggacccatcggacctgttgcacccgcaggacctgttgcacccgcaggaccgcgctctcccgcaggaccgcgctctcccgcaggacctggttcacccttagcaccttgtggacctgctggacccattgcacctgctggacctgctggacctggtacaccttgtggtcctgctggacccgttagtccttgttctcctcgttcacctctaggacctggttcaccctgctctccctttggacccgcagggccccgaggacccactgggcccgcagggcctggtgcaccaccgctaatagtatcggttgaattatcagtataagtaattttcaaacggccacccgctaaggtttccgtgtttttaattaacttaccaagcgtagaaatcgtaatatttccgttcgtttgttgtaatttaatattatttccggcgataaaggttacagtctcacccattttgataagatatggatcaaaatgaatagaagtaccttgaccaccgtctctctgagtgacattcagtttccagcctgcattatttacagcattgactacagtctcaatagttgcaactcctcgattccctattgacaatttgccatcagttctaaagtgaaacgtacctggttcagcggcattatcaatttttcgtttaatatcgtcggttaatttaaccgtaatcgtatcgccgctagcgtgggaaataagaccattttcgccttttacgttgagcgtacctgcccataaaccaacttttggttgttcttcagcgttggaatctccaccaattttcattgtgagcgattgaagctgcgccacgtttactgcatcagttaattctttacctgccgcaacgttgacgatttggcgtttgattttattattacccacagaaactgcaccgataagaaagtcattagaacctttaggatgaccctcaggactgtcatcaacactttgtgttgatttaaaaccattgctaacactactttcttctgttattacagaatgggattgtctcactccatctatacccccattcgtttgtgctgtcgaaccataacctaacgccacgccaccaccaacaagaacaattgaattgttaccaagtgcggttgctctccttgcttggttggtatttgcctggtcacccacagcaacagagcctataccattggcagaggctttataaccgaaggcagtagaatgatttccagcacttgcttcgcgtccaattgccactaatttctcacctgtcacattgatatgggcaccaataacaacagagtctatcccttctatttgcgcagaattacctatcgcaacggaatctggcccagcagctttcgtgttactaccaagagtaatagaataaccactagacctactattagaccctatcgcaataccatacagtacatctcctgcatgtgctatataacctatcgcaatagcagtcctaccttcagcttttgcgccctgaccgatgacaatagaaccaggcccaaccttactaccttcaccaataccaatagaaccaccgtcacttcctagatacccttgactagaatcattttgaagccatgctgctgaacctactggactaaaaaatatacttaataatactagacttaaaaaacttaatttaaatttatcttgctgtttatctaaaaaataatgtgaggtgcatagttgagctcttttatccgtgtaagtggatgttttggtatgagattttactaattcagatacaacaacccaagcctgttgagcatgactccaaataactctaaatattttattcataataataatcttcttctctaacgctttttctaataaagcatcataaacttttatttacattttcagggtgtacagatgcccccactccattgtaaaaaaaaaaaccaacatttacataaaataaagaataaaataacaagcatttttcaacttttattgtcaattattaaaaaagttagaaataataggcgggaaatttgatgaaagcggtgatttagatgggatattttacaccgcatcgtctcttgaacaggctgctatttaatcattatcacatagcctacttaacattgtcgtctaatcccaaaatatacgggctatttaaatgcactatcggtaaagttgaattattccactcccgcaataactgtactttcattaaatctaaagtatctaaaccagccaaagtgtttggagtatattgagtcgcaaagcgagccagttgcgtaagcccaagactagattcaatacttgaacttatcacagcaattaaaccttgctgatgagcctgttcaatgagtgaaatacatttttcaagggaaccaacgagcgttggcttaatcacaatagcggttagatttggctctttttttaccaaaaaatcaggctctcgtactgtttcatcccaagcgatatttatccctgtctgttcagcaaactgacgtgaaagttctggagttttgcagggttcctctaaaaactgaatgcgctttttgcgttcagaggcaattttacttgcaaaaagcaatgccttttctagcgtccatgagcgattagcatcaagccgcaattttaaatcgggaatcgcttctaaaaacatatccgcaataagcccatctcgattagcttcatataaccctactttaattttggcgattttttccccttgcatttggttcaattctgcataaagttcatctgggtcgccataacagagtggcacagtttgaaagttggcttcttcgcttaatgtttcattgagttctgctaaggcactgctgaccccaaatgcaacggacggtggataggatgttaaagaatcgtcttgatgatttagccacttttcaatccattggcgaactgcaatttccgcctctgctaaggtttcttgactaaattcaggcaatggggcgatttccccccagccttctttgtcagcatgttgcaaatgaataatcaaaccatctcgttgttttaaacggcggttacgtaagataatgcctgtttcaacaggtaaggaataacggtaaagttgagcggttttcatcggggttaactttgtatttatttatattcagacaacaaattactctcagccctcggttcaaaagggctgagatatttacgtagctgatacataataccgaaaaaacattcaaattacaccgcttaatactcaaaaaccacgccagcttcttccgcttgggctaaggcttggtacatagaaatccttcatacacgtaggggctaattacattagccccaaaatcatcggtaatatctggggcaaatgtaatttgcccctacaaattatcttctttcctgttttacaatcgtcgttggctcttggtggataatcacttatagaaatccttcatacacgtaggggctaattacattagccccaaaatcatcggtaatatctggggcaaatgtaatttgcccctacaaattatcttctttcctgttttacaatcgtcgttggctcttggtggataatcacttatagaaatccttcatatatgtaggggctcatcacattagccccaaaatcatcggtaatatctggggcaaatgtaattttgccctacaaattatcttctttcctgttttacaatcgtcgttggctcttggtggataatcacttatagaaatccttcatatatgtaggggctcatcacattagccccaaaatcatcggtaatatctggggcaaatgtaattttgccctacaaattatcttctttcctgttttacaatcgtcgttggctcttggtggataatcacttatagaaatccttcatacacgtaggggctaatcacattagccccaaaatcatcggtaatatctggggcaaatgtaatttgcccctacaaattatcttctttcctgttttacaatcgtcgttggctcttggtggataatcacttccgaatggggaaaggctgccaatattttctgttcaaggctgtcggtaatatcgtgtgcgataaccaaaggcagatgatcgtccaattctaaatgtagctgaataaagcgaattgcccctgcacgacgagttttgacatcgtgtatgccaataatgcgtgggtgttgcaaggcaatcgcccaaatttgatcgacttcttcttgaggtaaggctttatccaacaaggattgcaccgcttcccaacacattttggcagcattaaacagaatataaagggcaatgccaatagcaaatacggcatcggcataaattacgccgtagatatttaaaatcattgccacaagaattgccgcattcatatagagatccgtctgataatgtaacgaatcggcctcaatcgctgggctttgggtgagctttaccacttttttctgataccaaactaatgctgcagtgagaacaatggagaacaagctaatcgcaacgcctaattcactgctttgtactaattgtggttcggttaaacgttgaataccttgtagcaataagaatgttgcagaaccagtgataaaggcactttgagcaagggcggcaagggattccgctttgccgtgtccgaaagtatgatcatcatcggctggctgtaaagcaaaacgtaacacgagcatatttgttaaagatgcgaacaaatctacaagagagtccgtcattgccgccaaaatcgccatcgatcctgtctgccaccacgcaaacgcctttgcaataattaaagtagcagcgacaatcacagcaaagttcgctgctctttttacatattgattatactgtttttccattagttacactcaatttgccacgctaattgcgaaaactgccacgccatttgctgaagatctttcatataagcggttggattttgcaaattttttgcagaaacagaccgcttgtctgagagctgcatttggctgtaaccacactgagaattttgcccacgggtgacttccagctgataatcgttaaaacgctctgtgggtggataaagcacttggctttgtagctcgtcaccgacaatcgccactttcgctttggtatcaggctgtttagcgaaagtttgctgacgtaactccaccctatcagcaaggcttttttgttggctgtttttatcagtaaacaacaaaatgccttgttgccagttattcggatcttttgagctttctttgagtaaaaaaagcgattgttgcatttcatcaagctgattttgggtcactttttggtaggttttaccttgaaaattgacctgttcaggtatcgaaaattgcggtggtaccatcacgcagcccgttaaaaacagcggtaaaaaaaaggattttcgtaacattatcacgctattgtttctcatatgtaaaatagactttagttaaagtattccaataaaacttttcattattctttttattcattaaagaattaatatcttctttctctttcatctctcgtaaataaaactaatgttttattatacaaaaactgataataatagtcgtaagctaacacattttgcacatatccccttgtttctacaaaaggaatggaggcaataaattcgtccatcgccaaagtgccgtttgcacgttctaaccaacggctcactcggtgaggccctgcgttatatgccgccgcaattaaaattcggttatttgggtaggtttcatttaactctgctaaatgggctgtccccaacataatgtttttaaaagggtcgagtaaatctttttcgcctgtgtagctcagttgatttgctttggctgtttggctggctgtggttggcaataactgcattaaccctattgcatttgcgtgcgaacgtgcttgagcattccacgcactctcttggcgagcgattgccattgcaaaggttttagtgatttttttatgctgtaaattgagttcaaaccaatccgaataagcatttggcagacgtagcgataaataatcccacgcttttgcctgaatggttccttcaacggctaaatcaaaccaatcttgttgcaaagcaaagttactcaatgcaattttttcgtcaaaactcgccgcttgcagtaaatctagccaaacaattttggcagcactcagccgttttaacgcctttaactctgcaatgcggtcaagctgaggcttaaatttaagggtttgttgttctgttaatttgttaatcgctggcaatacgggctgataaggctgtcctagggcttgagccgccagcataggataaaatcctcgctctgtggcaagttgctggaaaatagccgcttgttgtgccggctggcttttggctaaccaataacgccattccgctttggctctggtttctgggcttaatagcactaaccatctatttaaatcgcttttctgccagatcgccgttcgtaagcggcgttcggttaaactatcctcttttaattcggctaactgtgcatctcgccactgctggaactggggtgttgtgttatcaaaaaagcgttgtagaaactggattttccattcacgtacttgattttcgctaagttgccactgctctgcccaagtttgatatggggcaaaatccacattttgcatttgttcaggcaatgttttgagaagtttggggaaagcgtgcaatacaagctgtttattgagatcgttaagcggttgtttcgcaataaaatgttgcaaataattcggctcagacaagagtttttgtaaatcggcaagccattttcctaactcgacatcttggttatttaacgctaactggcttaactccgcttttgcatttgttatccataatttgaccgctttttgcttcactttatcttcggtttttaacccctgatctcgccagaaggcttccaagttcgcacaatcagagggcaatgagccgttattgatccaaaaatcatcaaactttgctaaaagctgagctaactcaggcgataaaggttgagccagattatttgcttgtgccgcttctggatttaactgtaatttatctgcttggctttgatattgagccgcccacactcgacattgattagcaacgcttagctcaccgactttgtcgctataggctagaagctctgaccatttttgctgtttgtaccacatttctatcgggaactgttccagcttattgcgttttgcgatatgcggatattgcttgataaagtgcagaatttcttcttgcgaaatagcgttcaattttagtttagtatttaatatagcccattttatctcttcaatcagagggtaatcaagcaacattgcctctaaatgcaccactcgctcaaatatcgcattagaaaattttccctctcgttccatctctcgtaataaagtctcaagcagcaaaaaatttactctttgcttttccaattgacggtagatattttgttgctcgttctgccattgtaattttagtttctcaatttctggagatgactgagactgcgtagcccaagcagataaacacatcgccaaataaacaaataatatttttttccccataaactctcctagatactaaagcccaattagaaattaaaaaccgcttgaagtttatatcaacaagcggttaatttaattgaaagtttcacttcttattcatcaataatcactttcgcaatgtaatctaaattacgataatgctgtgcataatcaataccatatcccaccacaaactcatcagggatagcaaagccaacccattctactggtacatccacttctcgacgagaaggcttatctaataaagtacaaatcgcaagtgaggaaggttcgcgcaaatttaaaatatcatgcactttgttaagggtaaaaccagtatcaataatatcttctacaattaatacatctttgccttgaatttcactatccaaatccttcaagattttcacatctctgctcgattctgtacttaatccataacttgatgccgttaaaaaatcgacctcgacaggtaaatttaacttacgcaccaaatcagccataaacataaaagatcctctcaacagtccaacaacaaccagactctggctatttttatgttggtaatgttgattaatctgttctgctaactcagtaatgcggttttgaacttcttgagaagatatcatagtttcaatgtgatgttttttcataaacaaaccttttatctatatactatttaaaaatacaatatgatgtatcaaatgctattatacctcaatattctttgattaaataaaactacccattctccttttaagattaatcaacatttaaatgtgttcactacatcatttcatctacatggccatctatgaatttaggtaaatcagcaacactatcaataacataatcagcgtttaattcaccttcaggtgtaattggtttacctgtccgaaccaatattttcactttcaccccagcgttcttcgcagctaatatgtcctctaatttatctcctaccatgatagattttgaagggtcaatatccagatcagaaatagcttgtagcaataaaccagcttttggcttacgacaatcacaagcctttttataattaccaattccttcaggatgatgaggacaataataaataccatccaataccacaccatagtcttcatctaatgaccaatccatccattctgtcaattgatgaaattgtgcttcactaaaatagcctctagcaattccagattgattagtcactatcactagcatatatcctttatcttgtaactgctttaatgcatggccaacgcctttaataaacctgaaatcatcaatatcatgtacatagccatgatcaatattaattgtaccatctcgatccagaaaaatagctttattcgccatcactatttccttttaaaaagttaattaccaactggtgatgttcttttgttttaaatttattaaatacagacataattttgccatactcatccactaaaaaactaattcggtgaaccccatcataactttttcctaaaaattttttctttccccacacgccaaatgcttctgctaccttatgatccacatccgacaatagaataaaattcaaactattcttctcaagaaattttgctagcttttctggcgaatcaggactaatgcccagaaccatcacatttaaagaatcaagttcttccttgctatcacgtaaaccacatgcttgtgatgtacaacctggtgttaatgctttaggataaaaataaattagaaattttttgtttggaaattgatctagagttacccaattaaaattttgatctaatagagagaatgatggtacagtatcgcccacctttaatgtatccattattattattccttttagcccattatagaggcaataagtatatcatattctaaatatgcactaaaatattaagcataggaagattttcacaattcggttttaaataaaaatttgtgatctatgtcgtaaaatttaatttttcctattgcgcattttacatatttgactaaaatttacatcataatctaaccaagggagaaacattattatggaagttggtattgtaaaatggtttaacaacgccaaaggattcggatttatcacttcggactcatatgaaggtgatatttttgctcacttttcagttattgaaggagaaggctaccgctctttaaaaatgggacaaaaagttcattttgagttcactcatggagataagggagcttcagctgtacgcattgtaccaattactgaataatttcttaggggctactttagcccctaatttgttacccttaataaagactttggcataatagacaaaaaatagtaattaaaaccttaacaggtagacagtacccgtcttttgaatcctcttaatgcttgtttaaaatagcctcaatcccaataagattatttttcttccctactaaaattacaagacatcttcccaaattcatcaaaatacgtcgggaaagtttttgccgtacatttcggatctaaaatcgtcaccgacgtatttgacaacgccaccaaagagaaacacatcgccatacggtgatcgttgtaggttgcgatttcagcgtgctggaacttatctaacgcaagcggttgaatacggataaaatcttccccttcttccacttccgccccaactttacgcaactctgttgccattgctgtcaagcgatctgtttccttcacacgccagttataaatattacgaataacggtttcaccctcagcaaaaagagcggtagttgcaatcgtcattgccgcatcaggaatatggttcatatccatatcaatgcctttaagctccccctgctctgcttggataaaatcttcgccccaagtgattttcgcgcccattttctcaagcacatccgcaaacaagcggtcgccttgaatggaatttttaccaatccccgtcaccttcactttccccttaattgcccctgcggctaagaaataagaggcagaggacgcatcgccctcaaccaaatatttttgcggagaaacataatgctgattacctttaacaaagaaagtttgataattattatgcgacactgtcacgccaaaatccttcatcatcgcaagggtaatatcaatataaggcttggagaccaactcaccgacaatctcaatttccatatcgccggaggcaaggggtgcggacatcaaaagtgcggtcaaaaattgcgaagaaatcgaaccatcaatctgaattttgccgccttgaatacccaaattacgaatagcaatcggcggatagccttcattttcaagatattgcacggaagcccccgcttgcaataacgcatcaaccaaatgtttaatcggacgctctttcatacgcggctcgcccgttaaaatcacctcagcctcttgctcacctttcaaacaaagtgccgctgttaaaggacgcattgcggtgccggcattacctaaaaacagcgacaaaccattttgccactgaaacgcaccgcccacgccctcaacggtacaaacggttttattatcagaaagctgataattcacccccaaagctttcaaggcattgagcatatggcgaatatcatcgctatccaataaattcgttacttgcgttgtcccctgtgccaaggctgctaacaacaacgcacggtttgaaaggctttttgaacccggtaaattaatttcgccctcaacacgagcgataggatttagtgttaatttttccataatgaaatcccaataattaaatagtttttataatatctaaaaaacaacctcttagaattcactaagaggttgtaatccagaatatactcccctaccccgtattacgcatacctgccgcaatacctgtgatagtaatcatcaacgcttgctctagggctggatttggattttcgccctcagcacgtaagcggtgaagcaactcaacttgaagtaagttaagtgggtcagtgtaaacgttacgcagagcaatagattctgcaacccaaggtaaatccgccattaattgcccttcgtgagcaagcgagagaacggtgttgatgtccgctgcaagctgattgcgtaaggtattgcctagacggtgtaaatgttgtggcacaagacgttgatcgtaatgttccgcaagccataaatccgctttactgaataccatctctaacatgccgatacgggttgagaagaacggccattcggtacacatttcttttaatagcacttcattaccttgttcaatcaactgttgtaaggcttgacctgcccccaaccacgcaggcaacatcaagcggttttgcatccacgcaaagatccacggaattgcacgcaaactttctacgccaccatttggattacgttttgcagggcgtgaaccaagcggtagttttgacagttcttgttcaggtgttgctgcacggaaatacggcacaaaatcaggttcgccacgcacaatgccacgatagatgtcacaagatatttctgagcctttgtccataatatcacgccattcttgttttggttctggcggcgggcaaaggttggcttctaaaatcgcactggcgtataagtctaggcttgatacggcaacggcaggtaaacccagtttaaagcggatcatttccccttgttctgttacacgcaagccatttttgagtgagcgaggtggctgtgaaagtaatgcagcgtgagctggtgcaccaccacgaccgattgtaccgccacgaccgtggaataaagttaattccacattgtatttctcactcagattaactaatgcttcttgcgcacgatattgtgcccaagaagcggctaacataccagcatcttttgctgagtcagaatagccgatcattaccatctgtttgttgttgataacaccacgataccagccgatattaaagagatctgtcatcactttctcgcaatgatcgaggtcgtctaaggtttcaaatagcggtgaaacaggaatagtagttttgcaacctgcttcttttaaaagtaaatgaaccgctagtacatcagaggcttcacgtgccatagaaattacataggcagagatcacaccttcaggctgttcggcaaccactttacaggtatctaaaatctctttggtttcagggcttggtgtccagttggttgggacaagcggtcggcgagagcttaattcacgcacaaggaaggcttgtttatcatcttccgtccattgtgaataatcccctaaaccgatataacgtgtaatttccgcaatcgccatttcgtgacgagtactttcttgacgaatatctaaacgagataaacctaaaccaaaacaacgaatacgacgtaagcaatctaataagccaccgttggcgataatacgcattccacattgatgtagcgattggtaacagtcgtagagtggctcccaaagttgctcgtcatcggttaagatttcatcacggctaatggtaagcggtttatcttgcaagagttcatcataataagctaaggttttgataagttttgcacgcagatctttcaccacaacacgatatggttccaaatgatcgccatattttgcacggaaggcatctgttgcgtgaataacagaaagctcgtcagctaaagatttaatatcttcaaggaaaagctctgctgctttataacggttcatacgcaacactttgcgtgtcgtttctgcggtaacaaacgggttaccatcacggtcaccgcccatccaagaagaaaaacgcacaggtgcaagcccaacagggtactgaacaccaaagtttttctctaaatggaaatttaattgacgacaaaattcaggtaccgctttccaaaggctattttcaattaccgccataccccattttgcttcatcaacaggggtcgggcgttgagtacggatttcattggtatgccaagctaacgcaattaattgcatcaaacggcgtttaagtttcgtggtttctgcatcggttaagtcatcgtgttctaagcggcttaaacagcgattaatttcaacgtgtttatgcactaaagaacggcgagtaacttctgttgggtgagcggttagcactaaatcaatcaacagtttttcaacggtcgcaattactttttcagcaggcacattttgcgcttttaagcgagtaaataaagcacccatagagcgttcacctaacgctgcatctttattgtgacgagaaatcgtgtgatattgctctgcaatgttcgttaagtttaaaaattggctaaaggcacgagcaacagggataacatcttcgtttgaaatattggcaagaatatcaagaagttgctcacgtgatttttcatcacctgagcgtgatgcacgagacaatatacgaatattttcaattaaatctaaaatttcattcccttgggcatcgcgaatcgtttcgcccaaaaaatctcccaacatatgaatattactacgcatggattcataaatttggctcataaaatgtcctcttttcgataaaaattaactgggtgtagatataccgaaaaagagagcaaatggcaatggtatttagtttttttatgaaataaataagaaaattttatttttactcaatttttactttaatagcataataataaatttaataaggtgcttttagctaaaatcaatcgtcaaattaactgcttgtaaatacctagcctcatcaagcaagtccgccaatatcaaaggattctgcgccaagaatactttatcaaaggataaatgccacgatgaattttggatagataaattaagttccattggaatattcgttgcttgacgtgaacgatttagtaacactgccaagcggaatatgcgtaatagggttaaaatatcagggtgctgaaagcgacttgcaattttgagatcgtgtcgtttaaatcctttgaggtgataacgcattaatgtggctaacaaagtttgttgttcagaatcaaaacctggtagatctaggtttgcaataatatacgcagaatggcgatgagcaccgttgtggttaattgaaataccgacttcgtgcaataaacttgcccattgtaagatttctcgtaattcctgtatttgacgtttatttttccaagcggtcacttgatcaaacaaacgtaatgcggtgtcttttatgcgttctgcttgatgttgatcgatattaaattgttctgcgagggcttttgctgtccgttgtcgaatatctccaacttgaaattcactctcaacaccatataagattccttcacgcaatgccccatcggaatatcgcattgattgaatatggaaggtgtgaaataacgccagtaaaatggcaagccctggcactaagacatcggcacgctcttccaataatcctttgagctgaatttctttgagtgaatgaaatgctaaacaacgatcaattaaggtttgtaaacgtgcttctgtaattaatccatctcgatagccatttgcaatcaacaccttgctcacggttttaattgttcctgaagagcctagaacgtgttgccaacctaactcacgatattcccacgccaaatcatcgattttttccatcgctgtttgatatgcctgttcaaaacgtgcttgagttagttcaccagcagggaaaaaacgttttgcaaaactcacacagcccatatggcgactttctgctcgtaatggagtgaagccatcccctatcgtcatttctgtcgaaccaccaccaatatcaaccacaaatttacgctctttttctggttgtgtatgacttacccctgaatagattaagcgtgcttcttcttgccctgagataattttaatcggaaatgggaatacttgttgtgcttgtgttaaaaaatcttgattgtttaatgccctgcgtaatgtgtaagttcctacgactttcacattttcaggcgagaacccttttaaacgttcagcaaagagtgctaaacaagcaatgcctctgtctatagcttcttgatttaagtggcgatgctcgtccaatccttctgctaaacgtacacgacgtttaatacgagaaaggatttggattgagccattaacaatccttgcaacaatcatatgaaaactgtttgagcctaaatcaatcgcagcaaattcgcgtgaaggcatttccgacatagagcaccccaaatagaataattcaaagcaaagtgtatcactttttcattcaaaatcgtggtactgaacaattattttttcattttttaagttatatacccattattaatttgaggttattgatccgtttttgtctttttgttacattatcccattatttttttatggctttaaaaggagaggtaatgatcaacaacagaacaacagaacaacagaacaacagaacaacagaacaacagaacaacagcatttagcttagcatttagcttattactatgctgcttaggtattaatgcagagcagcttgaacttgatgaaatttctgtaatgggaaaagttcctgagggaaattcgataagttttctaaaagtaagtgatgctattattgatggagagaaattcaaaaatcgttctgcaacattagggaatgctctatctagtgaattaggcgtacatagcaccccatttggaggtggagcaagcgccccaattattcgagggcaagaaggtgttcgagttaagattttgcaaaataatgctgatgttgttgatatgtcaaatatttctcccgatcacgctatcactgcagatactctacttgctaatcaagtagaaattttacgcggtgcttcaacattgctttatgcaagtagctctcccgctggaattgtgaatatcgttgatcaacgtattccaaataaaatgcctaaaaaaggttatgaagtgacactttccagtcgatttgatacggcaagcaaagagaaagtgtatgcactaggtacaaccattggaattgggaaacatttagctttacgacttgaagggctagatcgtcaatcgcaaaattataaagtgccacaaattaaactaggtgaaacattaaattatgtgccagatacttatcatcaatcaaaagtaggaactattggtttatcttttattggtgaaaaaggttatctcggagcgtcttataatcagcgtaaagacagatatggattacctgggcataatcataaatttgatacttgtattgcccatatttacgatatgagattgcaaggaaagcattcttataccaatctttatccccatttaatgagtgatgaaatggtcacagaaaatcctcactttcattgtggtacagactacgatctcgatccaagccatagccacgatcacccttatggacacgaccacgatcatacccatattggaccttgggtagatttacactctaaacgaattgatataaagggagagattaaacaacctttgccgatgttggataaaattcagctaagttatgctcaaacagattactatcacgatgaaaaagacgcaggaaaatcaggcgatacaatcaacccaaaccgagtagataagagcaaagattttggtaaacccgtcaatattttcaaaaatcaaggcaaaaatgcccgcttggagttttttcatacgccaattggtggcttaactggaatgtttggcgtacagtatcaaaccctgcaaagcagcgctaatacaccaagcaaccgtgaagttcaatggcctttagtggataatcgcaacaagcaaattagcttatttgctttggaacaatacgcttgggataactttgcgattgaattaggattgcgaactgaaaagcagaatattcatattgactatgatttagctaagattcaaaaacaacaaaaattcaatgagaggacttatggtaaacaggttgatcctgatttatctgattatgatgaaaaagccatctcctatactggggcatttaattggtttttccacccagactatcagctctcgtttacagcttcccataatgaacgtttaccaactccgatggagctttattatcacggacaacatttggcaacaaactcgtttgaatatggaaacaaagatctaaaaaaagagatttccaataattttgaattaggtttgggctaccatacagaaaaattagattacaaattatcaacctattacaataattttgataattatatctacaatgaaacattatatcgctctaataacctctttatgcgccgttataatcaagctaaagcgacattttatggacttgaaggcattattaactaccgttttacgcctgattatcaattcagtgtatttggcgatatggtaaaaggaaaattaaaacagctacccgacataaaaggattaaatgatgtctatggagagccaattcttaatcctgattacgatcctgaatatgatgaaccagaagaccaatactatcgtccttacttaggtaaagagatgattaaacaggcagatcgtgtttcgccacgtctaccgcctatacgtttaggggcaagatttaacgcacaattgacagaaaacctctcaggttcagttgaatggatgaaagtctttacacaaaataaagtctccaaattagaaagttcaacaaaaggctatcaattactcaatgcgagtttaaattaccgcagacaaataaaaggtgtggaatataccgttagtttgacgggaaataacttgttaaatcaagccgtttacattcacaactcttatcacccctatgtaccacaaataggcagaaattttatcttaggcttagatcttagtttctaaaacctaacattatgtagcacttacataaattataacttttcgtagggactggggttatccccaccctacacaacactagtttttagctgccacataatatcgtattctttaaaggggatttaaccgcttgttttactagtcttacaaggaaaatttctctataatcgaccgtctgcgataaatctaacgatttttccacaaaatcttgagcaaaattttaaaaggtataaatatgtctaaatttccaacaatttcagagattctttctggcaaagttgccgtaggggaagaagttgctgtacgtggttgggtacgcactcgtcgcgactcaaaagctggtttatcatttttagccgtgtatgacggttcttgtttcgatccaattcaagccattatcaataacgatttaagcaattatcaagatgaagtattacgtttaactgcaggatgttctgtgattgtgactggcgtgattgtagaatcaccagcagaaggacaagcggttgaattacaagcaaaatctgttgaagtcgtgggttgggttgaagatcctgatacttatccgatggcagcaaaacgccactctattgaatacttacgtgaagttgctcacttacgtcctcgtactaacttaatcggggcggtagcacgtgtgcgtcactgtttagcacaagccattcaccgcttcttccacgagcaaggtttctattgggttgcaacaccgttaatcaccgcttcagatacagaaggtgcaggagaaatgttccgtgtttcgaccttagatttagaaaatttaccgcgtggtgaagatggcaaagttgatttcagccaagatttctttggaaaagagtctttcttaaccgtatctggtcaattaaatggcgaaacctatgcctgtgcattaagcaaagtttatacgttcggtccaacattccgtgcagaaaactcaaacacaactcgtcacttagcagagttctggatggttgagcctgaatttgcgtttgcaaccttagcggataatgcaaaactggctgaagatatgttgaaatatgtgttccgtgcagtacttgaagaacgtaaagatgacttaaaattcttcgagaaacacgttgataacacggtaatcagccgtttagagaactttattaattcagactttgctcaaattgactataccgatgcgattgaagtgttattaaaatcaggtaaaaacttcgagttcccagttgaatggggtatcgatctctcttctgaacacgaacgtttccttgcagaggaatattttaaatcgccagtagtcgtgaaaaactatccaaaagacattaaagcgttctatatgcgtttaaatgatgatggtaaaactgtggcagcaatggacgtattagcgccaggaatcggtgaaatcatcggtggttcacaacgtgaagagcgtttagaggtgttagataaacgtatggttgaaatgggcttaaaccctgaagattactggtggtatcgtgatttacgtcgttacggtacggtgccacactcaggctttggtttaggctttgagcgtttaatcgtatatgtcaccggtttacagaatattcgtgaagtaatcccattcccacgcgcaccgcgtaatgcgaatttctaatttttggaaaaaagataaggcaaggcgagagaatatctcgccttattgtttaaaccttgaatgataaggctttaagcccatttttagcaacaaatttgtctactataccaatttgtctattacaccaattttagtaagttatttaggaagagatttataaatgttctatcttattaaattcgattaactctcgcttttccccttgactttcaatcgcttggcgtagagcaagtgtggttggttcatcgtcttgataaagtcacttcaggcttgctaatccttgccctaaacccaacgagtgcaagttattttggtgagctttatggtggtgaaaaagccgatagagtttatttacacgcctatcagctcgatttttattatcactcacaacctatcagcgttcgtgtcttaccaagcggtcagttttggcaaaaacaaaacgatcaataatactcgtcttgtaattcgtcaaaggctgatccttcttcaaaaagttgctccaaaaaggtggctactttttgttttccctctttgcctagcccaaaaacgctaagatcgctattggataccgaaggtcgaactcgaacaatcgcatttggaaatgctttttcgacttgctctgccacaatgtctaaaagtcggttgaatttaccttgatccattttttgtaagttggctaaacgaatatcaatggttgcttgcataacattttcctcacctgactactgtatataaaaacattatatataaaaccagtttaactgtaaatagatacagatatttgttttggatcaaattttgatgctttaggtttatcacacgaagtgaagatcaaacttgatcctatcgtttactttgccggtatttcttataaattctaagaaaatcccatttcttacaaataaaataggcttccatcggaagcctatttttttaagtggtacgccacaaatttgtctactatgccttctaaatcagcaccttcctcaacgccataaaaaatctatcattttcctctggcaacccgatactcacacgcaaatggtttggcataccatagcctgcaatcggacgaacaatcaccccttcgtgcaacaacgcctgataaatcggctgtgctggctgtttcaaatctaccgtaataaaattgcctttagatggaatatattccaactgatttgccttaaaaaacgcctcatagcgttgcatttcattacgattattttctgccactttcgcaataaaatcatcatcttgcatcactgcaattgccgccgctaacgcaagactattacagttaaatggctgacgcacacgatttaataaatccgcaatttcagggtgagaaaccgcataaccaatacgcaaaccagccaaaccataggctttggacagcgaacgagagacgatcaaattcggatatttctgcactaacgcaaaagaatttaatcgctcagcaggatcggtaaattccgtataagcctcgtccaacaccacaatcacatttacaggcactctgtctaaaaagcgttcaatttcctgttgcaataaaaaattccctgtcggattatttggattcgcgatataaatcaacttggttttgtcattaatcgcctgctcaaaggcactcaaatcgtgtccccaatcttttgcaggaatttcacgcgctaccgcattaatcgctttagtcacaagcggatagacaataaaggcatattgcgaataaataatctcatctttatcgcttgcaaacgtatgggcaaacagctcaagcagatcatttgagccatttcctaaggtaatttgattaggctgaaccccaaactttttctcaatggtcgctttcagctcaaaaccattggcatcaggatagcgagttaaatcattcaactgctttaaaatcgcttgtttcgcactttcaggaaaaccaaaggggttttcattcgaggcaagtttcacaatatttgaaatcccaagctcacgctcaagttcttcaatcggcttccccgcttgataaggggcaagggttttcacgccctcattggcgatgttgataaattgcattgttgttccttttttcttaatgtttcgttgcagtttatactgtcgtcaattcatccgcaatcacttccgcttgttccaacacaaattggattgcctcatcgcatttatctggtggatatttgaataatctcaacgttacacgcaccaagtttcgcattttggcacgcacggcttctttatattgccagtcaatagtggcggatttacgcagtttatcggtaatcgcttttgccaagtttttcaaggcatcatcgcccaattctcgcaccgcactttcattgagagcaagggcatcgtaaaaggcaatttctgctggtgataaacccaatttctccccacgttgcaagcgttcggcaaattccttgctcatattcagcaactcttccaacacttgcataatggtgagattttggttgtggtatttgtttaacgcctctttcaaacgctcggaaaaatctttttgcaccgccaaattgcctgttcctttttcattgatttggctacgcaaataacgctccaccgccaacagccaaagctccttggtttgactgtttttgattttctctaaaaactcttccgacaaaatattaatattcggctgttcacgattgagcaaatcaaacaggttaatcgcaccgcttgcgtccaccgccttattcaataatgccaccaactgcaactgacgttcttcgcttgaagcggtggaatttggctcacgttttgccaaaatcgctcgcaccgcatcataaaaggcaagctctttttggtactgctgaacatcgccgtctgcaccgcataagctaaagccttttttcgccaaacgcaccgcttttaaaaacgcattgcgtcttggggttttctcggttttatccgcaaccgtttgatgatctaaggcaagaatatggttcgcccccaacattacttgcttgaacaacgccagttcatcttcaattttcaaagcatcaaatagcttaaacgactgattgttcactggtgtggcaaactgcccacgcacaacgtcaatgtattccaacatcttcgccttaatttcggcgatattgtgggtcatctgccctttgccgtgcgagcgagtatattgttctgtcgcttcccgaagttcgctggttagccccacataatccacaatcaaaccgccattatcacggcttttattgcggaacacacggtttacccgtgcaatcgcctgcattaaattatgccctttcatcggcttatcaatgtacatcgtattgcaacaaggggcatcaaaacccgttagccacatatcacgcacaatcacaattttcagcggatcgtcaggatctttaaaacggcgttccaacagctttttatcttgcgaagaatagatatgtttttgaatgtccgcaggatcgctcgccgaccccgtcatcacaatcttaatcgccccttcattcacatcatcgctatgccactctggacgaagtgcggtgattttttcgtacaatttcacacaaatctgacggctcatcgccaccaccattgccttgccgtcaattaaagcggtgcgttgttcaaaatgtttaacaaaatcttctgccaaacggctcaaacgcccctctgtccccattaatttttcacgcaaacggaagttgtagctactttcatcatcttcatctattaacgtttgggcttcttgcaccacattatcaaactcggcactctgtgctatcggaatttgccgtgcttcataaataatcggcactgtcgccccatcttccaccgcatcggtaatatcgtaaatcgacacatatttaccgaacacttcctgcgtatctttatcttcaagactaatcggcgtgccggtaaaaccaataaaagacgcatttggcaaagcatcacgcaaatgttttgcatagccgacacggtatgtccctgtgcgatttagctcgttgagtttcatactttggctaaaaccatattgcgaacggtgagcctcatcgctgatcacaataatattgtgtcgttcgtttaacacagggtgagcctgctcgccctcttgcaaaccgaatttctgaatagtggtaaaaatcacaccgcctgtttcacgcttggcaagttcttcacgcaacgcctccctgccgtctgcttgcacaggttgctgacgaattaacgcctgaccgcctgaaaaggtggcataaagctgaccgtccaaatcattgcgatcggtaacgaccacaatagtcgggttgcgtaactccgcttgcgacaacaatttgcccgcataaaacaacatcgacaacgacttgcccgaaccttgtgtatgccacatcaccccgattttgccattgccctgctcgctagccgcccacagcgtacaatccaccgcttcattcacgccgtagaattgatgataagcggcaattttcttcaccaaacgaccgcttgaggtttgctcaaacacaataaaattctggatataatccaacaaactcgcagggttaagcaaaccacgcaccaagccttccaactcgtgttcaaacgaaatacgttgcttgttcttctcgtccaccacacgccaaggggtaaaccgctccaaatctgccgtgagcgaaccgaccttcgccaaaataccatcgctgatcacaagggcttggttatacacaaacagatcgccgatttcctgcttatacgtctgcaactgattaaacgcctgtggcaaatccgcattctctttcaagggatttttcagctccaataccaccacaggcaagccattgatataacaaatcacatcagggcggcgattacccttccgccccaaaatcgtcagctggttcacgacatcaaaacggttcaggcttggctgttgaaaatcaatcaaacgggcaaattccaccttttgctcatcattttcccgatactccacccgaacgccctcacgcaaatagcgataggcttgctgattacgctccgttaaatccgtaatatccgttttgcacaccaacgccaccacttcgtccaccgtggcagacggcaactgcggatttaaccgctccaccgcctcacgcaacaccgaacgaaacaccacctcgtccgtccgcaaccgccaaggattttccccatcggcattgatggtcgaaccgtgcgtataatcccaacccaattcctgcaaatgttgcaaacaggcttgttcaatggtgttttcgttgatgagcattgtttttttccttttttgttgatatatcgtaggggctaattacattagccccaaaatcatcggtaatatctggggcaaatgtaatttgcccctacaaccatgggtggcaatgccacccaattatgcttaaccgattgcacaaagtcgctgtcgggtttgcaaaattttgtggggatgttaccacttgtcgttttataaaataccgtattaaaaattctttttgggaaaatgaaaaatattctctaattgatgaatacaatgttcaatatccttttctgcaactttatttaaccttaataatctcttccaagatagccgtattgcagatttaacattatcttttatttcccaatccacaactttatttctatcaaattcagccgtgatattattcgctaatatgattaactgatcttttggtttatagataaatttaactaaaatttctactaagttctgtatatcttcactatttttcgctaaattttccagtaaattagactcgatattattactgatattactagagaacggtgtaatagttatattttgactactttcttctgatctcatcgttgaaagcatattacaataatctgctgccccaactaaatcaggaaaaagattagcataatgtacgttcatctgttttaatgataatatgcaatctaactgtatctttgggtcatttttgatataaaccttacaaatatgttttgcaatttgagattctgcttcttcctcatcaatagaatagctctcctcatcttcatacaagctatcaataattaacccttcaattgttttacctgccttagctttaataaataaaccggcttgatttactaatcgaccatacatatcaattctcggttcaacaaaatgaatatttattttttcatcaagcaatgttttattcgcaatataaattgctcgatattcattaggtttttcctgttcgacatctttttttgaaaaagcaaaaaacagtgctacataaggcgaataagtccaatctaataacggcgtattcaaaccataatgttgcccaatagcccaaagctcatcgtctgaatcttcgtcatcctttaaaatgagagaattatccttaattcttcctcgaatagctcttctaaaatttgccaattgaaattcggaaagagcttcactaaaaagggatgttttactatttcgagcaatgttaggcactaatccccaatcatatcgacgctgtccccgataaattagctcgctaccgccttctttaaaaaatggttgattgataagctctataaatgttttccaattatctacctttaaaacaggaattcttccacttatttcatcgctaagtattgaaaaatcaacattaccattattccaagttggaatgtcatcaaaataattagtttccatttaatatttccccactcaacaacttcggcaataataaatctctaatattttccaatataaaactattttttctttggtttaagatagaacataaaatatttttatacatttccgtgaagtaatttaatacaacatcacaaggaactattatttcataatctaatactcttgctttatctgtatgtggaattgatgtccctgttgtattagcttgaatatcttgctctttactgaacataaataggttaaataaagcccaatatttattttcacttagttccatttttgcaaatgttgagccaataacacctttatgtccgatcgctatttttccagatgcagccccatccatcaaaatcaacgtatcaaaaatatcgcaaacgattgatttatctatttgtgcatattctgtatattttcctgataatgaagccattaaaatatgtggcaaaaatccgtcatctggttcagaagaaattaatttaggtttcttgcccttaacaattttagcaacctccccaactttcttactctcccacccccacggcactccctcttcatcaaacccactcgggaatgcctctgcgatttcccatagttgttggtattgttcgggatttgccgtctgcaagcggtgtaattcttgcgtgtttttaccactgatcactgccattgccgcttgggtggcttgttcagcggtttgtccgcttgccagtgcgttggctttggcgtgaacagggtcaaaatcaataaaccagcttttaaaaatcgtttgggcaatttgttctagggtttggttgatttgggtgttgagttggatttttttatctaaatcagataatttattcgcaatctctttttgtatatttaatggtggtaaatcaaacgaatattttgataaatcaccaattttcatatttaattgaacagatgttcccccagaaataccatcaatataacttataaaagatttagacttaaatacataatatacatatgtaggatatgcaatatctttttttaatctaattctagctaatccattattaaaaacagcaggaagatcttgtttagccaaaaaacatattcctgtagaacaagttctcgccattataatgtcatctttcattaatctgaatttactataatctgtgttttttacttcagtaaatccccaactttcaataggcttattctgagaaatatcttgaattctcaaacatttaatatctgtctcaaaatcgactataggtgctctacgaatagcatctagcccagtatttatgctttcagaaatatcttctaaagtaaccttcttccaactactcataccccaaccctcccaaattcgctttaattttggcttctaattctgcactttgcttaaattgttgttgtaaaagcgtggtcagttcttgcattttttctgcaaatggcacgccatcgtcttcttgctcggcagcaccgacataacgcccaggggtaaggacgaagtcgttttgggcgatttcgtcaaggcttgcggtgtagcagaatgcagggatattttggtagtcggcagattgttgccagctgtggtaagtgtcggcgactttggcgatgtcgtctgtggtgaagtcgcgtaagacacggtctttcatatagccgagttggcgtgcgtcaataaacagcacttcgcctttgcgtgctttgtttttgttcaaaatccagatacaggctggaatctgggtgttggtaaagagttggcttggcagggcgatcatcgcttccacaaggtcggctttgagaatatttttgcggatttcgccttcgttgttggtattactcgacattgagccgttggcaagcaacaacgccattcgtccgtttggcgaaaggtggtaaatcatatgttgtagccacgcaaagttggcgttgccttcgggcggtatgccatattgccaacgtgggtcttgggcaaggctttcgttccaccagtctttcatattgaacggtgggtttgccattacaaaatccatttttttatcacggtgttgcggattgctgaaggtgtcggcgttgcctttgccgaagtcaaattcaatgccacgaattgccatattcattgcggcaagtttccaagtggttgggttgaactcttgcccgaaaatgctcacttcgctgacgttgccttgatgttcgcggataaaacgttctgtttgcacaaaaaagccacccgaccccattgctgggtcgtaaatgcgtcctttgtagggttcgagcatttcgataatcagggtaacaatggattttggcgtgaaatattgaccgccctttttaccttccgctagggcgaattgtccgagaaaatactcataaacgtgaccgagaatatcttttgccgccaaggaaatcggcttgccgtcaagggttggacgggtgaagttggtgtcggaaaagagatcgattaagcctaataaaatactttcatcaactttataagggctgatacgttgaatgacgtttttgagttttgggttatcttgttcgatggcgtcaaaagcgtcatcaatcaagttagcaatgcctttaaaggttttctcgtcccagattttgtcgccaatgttagcacgagccacgactttgatttcgtcccaacgggcttgttgcggcacccagaatacgttgtcttgggcgtagttgtcccgttcttccagttcggcattgagaatatcggcaagttcgctttcgctgtaagcggtcgggtcgagataaaaatcggacgttggatcggtgtagcgttgtttgatgatttcttgttgtgccgagaagctgtcggaaacatattttaagaagattaaaccgagaacgatgtgtttgtagttggcagcgtcaagctgttggcgaagtttatcggcggctttccaaaggtcggcatcgagtttgttgagaaaggcttgttgatctgcttgctgagtagttaaattttcagccagatgtgctgtgctgtgctgtgctgtgctgtgctgtgctgtgctgtgctgtgctgtgcattatactatatctccgtgagaaatttcaataaaaatcaataaattacactttgctatttggacacgatgcgtcgtgtccctacaaatacttcggattttatttttttcgaatatccctaattcaacgttattgtagggacgccacgcttggcgtccgttcaataggtcagattatttattttctgcctcaaacttctgcataaacgcaatcaacgcttgcacgccttcaatcggcattgcgttgtagattgatgcacgcataccgcctaacactttgtgaccttttaaggcttgtaaaccgctagcggttgcttctgccacaaattttgcattgagttcgtcgttgcctgtggtaaaggtgacattcattaaagagcggttcgctttggcaacagtgttgcggtagaagttgctgttatcaaggtagcgataaagtaattctgctttagcttgatttcgtttttcgacttcggctaatccgccgatattgagcaaatgcttgaataccaaagaacaaaggtaccacgcaaatgtcggcggtgtgttgatcatggagtcgttattggcttgggtttcataattccaaatagatggcgtagatttacgggctttgccgattaaatcctcacgtacaatcacaagggtaatccctgccggccctaaatttttttgcgcaccggcataaattaagccaaattggctgatgtcgattttgcgggaaagaatattggacgacatatctgcgaccagcaccgcattgcctactttcggcacatcaaaaatctctactccgctgatggtttcattcgggcagtaatgaacatagtcgtactgttctgcaatctcgctaaaatcaaggctacccaccttgagttcatcgccttgctctaaaatattgatttcatcaatttcacagaaattacgagcttctttcgccgctgtcgctgaccaatgaccgctagttaaataaagcgccttgcctttttcgccgattaagttcatcggaattgccgcaaattgccctctcgcaccaccttgtaggaataaaattttgtagttttcaggaatgttatagagcttacggaaattttgttcacactctgcgatcatttccataaacaatttaccacgatggctaacttccattactgaagtgtgttgattttgccaattcaacaattctgcttgtgctttttctaatacggcagtcggcatcatcgccgggcctgcactgaaattataaacttgtgtcattgtgtttgcctcttataaaaaatggtgctttgcattctagcggaaatatggggctgtcaaaaatttcaatttttatagcttctcacgtcgataatataaggtttctgatacttcaaaatcatagtatctgcggtcataaaaaagacattttctacttccgcctgagccattaatagacgatcaaagggatctcgatgaataaaaggatactgagcttgttttagaatatggggtaattcaatagctagcattcgacaacctacctgaattaagccttgctctaaggcttctacatcaatgtcaaaatcaggtttacctaaactagatttaatcgcaatttcccataaacttgctaaactaaaatagatttcactggtcgggtcatcaagtaattccaccgcttgtggcgataggttttcttttttatcccacgcaagccaaagcaaaatatggctgtctactaagatcttcattcctcttttccttcaaacattgccacaatttcattttgatacaagcggtcaaaatcttcaggaatttgcatattttgctttttcataaaaccaaagcgactgccattttgtatagtatccaaaggcacaattttaacctgtggtttacctgattttgcgatgatgatcggctttccaaaacgtttcacatcttcaacaatgcgagaaaaattggtttttgcttcgtgcatattcacactttctaaagattgatttagcataacagcccctttttcttagtccgataagtgagtctagtcttattttctagcttattcaagagattaattcgtcgcttcccccattaccgcctcaatctccgcaatctctttcggcacacccgaagtgagatttttattgccgtattcagtgattaagagattatcttcaattcgaataccaatgcctttatattgctctggaacatcggcatctttcgggatatataatccaggctcaacggtcagcaccataccgatttcaagcggtcgatctcgttcattgccatagtcgccgacatcgtggacatctaagcctagccaatgtcctaagccgtgcatataaaattgtcggtaggctttattctcaattaactcatcaacattgccttttaatatgcctaaacgtaccattccttctgtcataatacgcactgctttatcgttagccagtttgatcgagctttgcggtacaagcagtttagtcgcttcttttaaggcttccaatacaatttcatacacctctttctgagccgtagaaaatttaccattaataggaatagttcgggtgatgtcgcctgcatacattgcaaactctgcccctgcatcaattagcagtaaatcaccatcttttaacacttgatcgttctcattatagtgcaaaatgcacgcattattgccccctgcaataatttgattataggacgcaaagcgagagccaaaacgagaaaattcgtattgaatttctccttcgatttccatttcgtaacgatttgggcgagtttgtttcattgctcgtaaatgcccaaaggctgaaatttggcaggcttgttgtaataaggcaatttcggcttcagatttgaacaatcgcatttcagagagtatcggttgccaatcaatcaaagttattggggcttttttacggcttgcagtgatggcatcaaaggttgcaaaaacaatctgatcgccccacgtttgcacatttcttgcatagtaacaagcggtcaaatctgtccatttttctgcaagaatggtttgaatatcttcgatatcgtaggcttgatcgacgtttaacgtctgtggtgcaacttcaatacctaaacggcgaccgttccacgtttccattagcggatcttttttgcgtaaaaaaatcaagctctcacactgccctgcttttttcagcaacactaacgctgatttaggttcagcaaatcccgtgagataccaaaaatagctatctggacggaataaatagtcgcagtcgttattacggcgtttttctgtttcggtaaagacaatcaaggttgagttgtcttgcatttgttcaaacaaacgctgacgacgagtgtgaaattcttcttgggggagtttttgtaaataagcgagatccataatcattccttaaaatcgatttttgaacgttacaagcatacctatcttcactaaaattgacaaatgctaatactattttccaactgttttaacagattaactcgactgaaatctcacattgcgcttgaaaaagctgttgattacaatccataaaacacccaaaatatactcataatagtagggacacactgcgtgtatccgtaaataaaaaatgaaccatttaaagtgtccgtagggacgccacgcttggcgtctgtttcatttaaccttactttacaggcggacacactcagtgtgtccctacgatattgatatttgtaaaaattatattgacattggacgccaagcgtggcgtccctactatatcttttgtttaaatgctatacataacaacaggtaaaaccgtttctttcaatctttaattattttttaaaagctcgcaaatacgctttttaaggaaaacactatggcaactattcagcaatttttagacatcgttgagcgtttacgcgacaaagaaacaggctgtccttgggatattaaacagacctttgacacaatgctcccgaatctattggaagaaacctatgaagtggcggaggcaatttatactaaaaatcgtaccgctttacgtgaagaattaggcgatctgttgctacaagtggtatttcttagtcaattagctaaagaagaaggaatctttagctttcaagatgttctaaacgatattcacgacaaattaatttatcgccatccacacgtttttggggataccactgccactaacagtgaagaagcactacaaaactgggaagcacaaaaagccaaagagaaagaagcgaaacagcaaacgtctatattagatgatctgccttttgctctgcctgcccttactcgtgcagacaaactgcaaaagcgttgtgccaaagtcggttttgactgggataatccgcaagatgtctttgccaaagtggaagaagaattggctgaagtgcaagaagaaattcaacaacagcaaccggaaaaattagcagaagaattaggcgatttattatttgcaatggtcaatttatgccgtcatcacaaaattgacgcagaaactgcacttcgccatgcaaatgtaaaatttgaaaatcgctttagaaaaattgagaaccatctgatttatcaagggaaaaaaccgcaagactgcacattatctgaactagattttctatggaatgaaataaaaaaagtagaataaattgacaaaattaggtaaagtaatactatagatctgtttatgtaaagataatttatgtaaatagtcaagaaatgatcaatggaatagggaaatagagctatgccaaaaattttacttgttgacgatgatgtagatttaactgaattactttcagaattactctctcttgaaggctttgatattcatactgtacacaatggtcaggatgccttaactgaattaaagatacagagttacgatctcattctacttgatgtcatgatgccaattctcaatggtattgaaaccttaaaacaggttcgtcaaaaatactcaaccccagttcttatgttaagtgcaagagatgatgaaatcgaccgtgtacttggtttagaacttggtgcagatgattacctgccaaaaccgtttaacgatagagagttggttgcacgcataaaagctatcttacgcagatcaataacgcagaaaccaagtatgccagttgaaaccgctttcattgtgaatgatgatgacgaccgaaaactgttacaatttggtggcgttgagcttcaccctggtcgccaacaagcgatttacgaaggaaaagatttagatctcaccggtacggaatttgcactattacaaattttaatgcgtaaccccggacaaattcttttacgcgaactcttaagccttgagattttaggtaaacgtttaacgccatacgacagagcgattgatatgcatatttctaatttgcgtaaaaaacttcctgagcgtaatgataatctcccttggtttaaaaccttgcgtggtcgtggttatttactagtgactgaaaaataatcataacaaaataaagtccctcagcttgtgtatagttgggggatttttctatctataggttagccgttatgttaaaacttagaaatttccgaagatatttagcctatcaaatctttgcctcttttatggttaccattgccattattttggctcttgctattttactgccaagtttagatactcgtcgtttcaagcaaattgacgattttcaattaggctttttacagcacgaaaccaaatatgtagaacaagaatataatttagacgaagtgtttcgcctcaatctctctgtagcatctattaatggttttgacattatcctctttgatcacgcctcacaacaattagcaggaataagagaggaaaataatgaagctttccacgcttttatatataaggcaaaaaatcaccgccaaccattacaaagacgcttcggcacaatggaattttacggtccttttcttgcaagttctcacactcgcacttacgacctctatttcactaaaaaagtgaaccctcaacgagagctcattaatacattatttgactcgccttggataatgctacttttgtttctttttgtcagtagcccagtgatgatctggctatcgtaccgcattgccaaaccagtaaaagaactgcgtttaaccgcaaatgcagtagcacgaggaaacttagccatcaatcccaaattagaaacctcaggcattgaagaactccgtcaagtaggagcaagttttaatgaaatgattgtcgcattagaacgactaaccaactatcagcatcgcctcttatccgatatttcgcacgaattaaaaacccctttgactcgaatgcaattagctttatctctcttgcttcgtcgaaatggtgaaagcagtgaaattactcgtattgaaggtgaaattacaaaactggacacaatgattcacgatttattggttttatctcgtaaacaagctaatcaccatctagagcgagaagtctttccaatccataaaatatgggacgatgtattaaatgatgccaaatttgaattggaacaaagtggatttgatttagtcgtaagccaacgtatcctccaccctgagcgttactttgtaaatggcaatgttgtattgttagctagtgccgtcgaaaatgtcattcgcaacgccaaaaaatatgctcaaacaaccgtaaaagtgatgttttatattgataccagcgatctttatattcttgttgatgatgatggagaaggtgttccagaagatcaatatgaagaaatattccgtccgttctatcgtgttcaagaagacagagcaagacaaacggggggaacagggcttggtttatctattgttgccaatgcaatacgacaacatcacggttcagttagagcagaaaaaagcccattaggcggattacgcgtcaaaatgcaattgccgttgtgggtggaataatatcaatatattgtcaatatctttaaccttgttatgaaaatgtagatataatgtcgcactttattcaattttcaggtaaaacatgcgtttagataaatttatagcagaaaacactgggcttactcgctctcaagccagtaaagcgttacgagccgggcaagtcactgttaatggtgtggttgaaaaaaatagtgcaaccaaaatcagtgagcaagatgagatctgttttgatggcgaaccactagcttgggttgatgaagggcaatattttatgctgtataaaccacaaaattgtgtttgctctcacgatgatggcgactacccgacagtatttcaattttttgactatccacttaccacaaaattacattgtgcggggcgtttagatgctgacacaacaggcttagttttattgaccgatgatggacaatggtcacaccgcattacttcccccaaacatcattgtgaaaaaacctacttagttacccttgctgatcccgtggaagatttttatgccacgcaatttgccgaaggcattttattgcgtggtgaaaaaaccttaacaaaacctgctacccttgaaattttagatgattacaatgtcaatttaactatcagcgaagggcgttaccatcaagtcaaacgtatgtttgctgctcttggaaacaaagtggttgcattgcaccgctggcgaattggtaatgtggtgcttgatgaaactcttgctgaaggggaatttagagctttgactgaagacgaagtagcgagtttttaaatgaacaagataactaaaccaaatggattttttgtggtgattatgggattactctcaatgttgccaccgcttgcaattgatatgtatctaccatcttttctcgatattgctcaagatctgtcggtatctcaagaaaaggtgcaaacaactcttgcgatttttactttcggctttgcaattgggcaacttttttggggaccaattgccgatagtttcggacgtaaaccgattattttacttggcttatctggcggggctgtcgcagcttttttcttaacgcaagtattgagtattgaaaatttctatctattgcgtctattacaaggcttatttggagctgcacctgcagtggtacttggggctttagtgcgagatatattcgatcgcaaccagtttgcccgattaatgtccaccattatgattattacgatgatcgcaccgcttgtagcgcctattttaggcggatatgtagcgaagtggctacattggcacgctattttttatattttaatggtgatggggattgtctgcgtttgtttagtagcaacgcttattcctgaaaccttgagtacagaaaatcgaatgccgttgagttttcgtcaagtactacaaaattttacgacattgatttcccataaagcaacgttaggatatgttctcgttggtggaatgtcctttgcaggaatgttttgctttcttacttctggctcgctggtttatattgggctttatggggtttcatctgaatactttggctacttttttatgctaaatatagctgtgatgatggtgatgacctttatcaacggacggcttgtcaccaaaatcggctcagaaaaaatgttacgcattggaatgagcttacaacttctagcgggtatttggctgattatttctgcaacattgcaattaggtttgtggtcaatggcaattggcgtggcattttttgttggaatggtttcgaccattggtagtaatgcttctgcggctattttagatcgctatccacaaatggcaggtaccgccaatgccgtagctggtactgctcgctttgggattggttcattagttggggcaggattatcccatattccgctaaccagcgagcgtccaatgctctatacgatggcggcttgtacggtagttggatttattgcctattattttctctcttgtagaaatcagcaacttcaatgacttttgcctattaattcataaaacagataatctttttttcgattgataaaaatcctaataaatccaaagcattaaaatcttaaaaccataaaaacaagaagatttagcataatatgctaacatatcacttaatatgccaacttaaaacctatttcacagaataaaaaaatgcaattttcccaaaaatagcattttacttttgttttgagtagcgatatattccaaatcattcttttacaagcggttggatttgtaagaagttttaacaagatgtagggacacactacgtgtgtccacataacatcggtaaacggacacacgcagtgtgtccccacgtttatgttccatattgaaatgttgtggtaattttttatgtgatccccccgcttgtccccttgcattgagagttggacttatgaaaaaaaccttatacgaaaaattatttgatgcccacgttgttcacgaagctgaaggtgaaactcctctaatttatatcaaccgccatttggttcacgaagtgacttcaccgcaagcctttgacggtttgcgtgcgatggggcgtgaagtgcgtcagccgaccaaaacggttgcaacaatggatcataacgtacctaccgatagccgtgacttaggcggttctggcgaaatggggcgcatccaaatggttgagctggcaaaaaataccgagcagtttggcgtgaccctttatgacatcaaccatattaatcaaggtattgttcacgttatgggacctgagcaaggtttaacccttccaggtatgaccattgtgtgtggcgactctcatacggcgacacacggggcatttggtgcattggcgtttggtatcggtacatcagaagttgaacacgttcttgcaactcaaacggtaaaacaagcccgtgcgaaaaaaatgaaaattgaagtgcgtggcaaagtgcgtgaaggcattacggcgaaagatattgtgcttgccattatcggtaaaactacgatggctggcggtacaggacacgttgttgagttctgcggtgaggcgatccgtgatttatctatggaaggtcgtatgaccgtgtgtaatatggcgattgagcttggtgcaaaatcaggtttaattgcaccagatgaaaccacttttgcttatttaaaagatcgtccgtctgcaccgaaaggtaaggattgggacgatgcagtcgcttattggaaaaccttgcacacggacgaaggggcagaatttgatacggtggtcactttagaagccagtgagattgagccacaagtgacttggggaacaaacccaggacacgttatcggtatcaatgaaacgatcccgaaccctgcggatatggcagatccgattgagcgtcaatcggcggaaaaagccttagcttatatgggcttaccgcacagtattaaattgactgatgtggctatcgacaaagtgtttatcggttcttgcaccaactctcgtatcgaagacttacgtgcagcagccgccgtggcaaaaggacgcaaagtcgctgatggtgttcaagccttagtggtaccaggttcaggcttagtgcgtgaacaagcggaaaaagaaggtttagataaaatctttattgaagcaggctttgagtggcgacaaccaggttgctcaatgtgtttggcaatgaacaatgaccgtttagagccaggtgaacgctgtgcttcaaccagtaaccgtaactttgaaggccgtcaaggtcgtggcggacgtactcacctggttagccctgcaatggcagctgcggcagctgttcacggcaaattcgtcgatattcgcaacgtagaattacactaaggaataagaaaatggcaaaagaatttaaacaacatactggtttagcagttccacttgatgcttcgcacgttgataccgatgcaattattccaaagcaattcttacaaaaagtgacccgtgtcggctttggcgctcacttattccacgaatggcgttttttagatgatgaaggtaaacagccaaatcctgatttcgtgctgaattttccacgttatcaaggggcaagtattttattggctcgtgaaaactttggttgtgggtcttcccgtgaacacgcaccttgggcgttagatgattacggcattcgtgctattatcgccccaagttttgcggatattttctatggcaacagtttaaataaccaaatgttaccagtgcgtttaagcgaagaagaagttgatgaacttttcaaatatgtcgaagcgaatgaaggtgcgaccattactgtcgatttagaagctcaaacggtttcggcaaatggcaaaacctaccattttgaaatcgacagcttccgtcgtcactgtttattaaatggtttagacaatatcggtttaaccttgcagcacgaagaaaaaattgcagattacgaaagtaaaattcctgcgtttttgcgttagttgcagataagtttttctatttaaaacatctacaattattggtggcagcgttgtctattacaccattttgtggggcatagtagacaagtttgtctactatgcctgtctctgctgagaatcagcttttacgaataattaaatgataagaacacgccgtgtttctacccatcaacaccccaatctctcgctcaatctgtgctaaagtggttcatatagacaattaacaacggaattttcccttgttcaaataattttacttcctctttccaccaacatttttctaataaaatcgaatgatgatataaagtttttagctgtgataaactttcagcaaccgcttgattttaggatcttcaaataaatctttacgataaaaaagcatcagaaaacttggatcaaagggaacctaataaatttttttgttgaaattggcaaaaactgtgaagaacattgcttgaaaaatagttcgataatgtttctaaagaaagataattttcttctttaatccgttttataatttctcgctctttttcttccttattataagtgagataaagttcaaaaataaaattatcttgctgaaagtttgcattcagattttcatacaggctactatattttacatcaataatatttggcagaataatcgcaattttattgcttacacctcgttttaactgagccgcttgcatattgcgttggtagcctaatttttcaatcgcacgctgtactttttcaattttgtctaaatttacgccactcttgccatttagcacatttagaaaccgtacataaagaaccccctgcttctttagcaagatcttttatcgttacaatcattgtcgtaccttaaaactttactgctctatttttgccttatatacaaaaataactattaccatgagtcaagcacatgaaacatgtatttacattatgttaatcagttttctagtattatgtagctttgaaccaaagaaagaacagtaggaacgccacacttggtcttcctactgtataaaaagtttatgcatatattactacagcctgaagataattttcatcgttttattctcccgacactttcaatttttccaataaaattgaacctgtctgaatattcgaacgatgttcaatatcatcaccaacagcaacgatatttttaaacatctcttgtagctgtcctgcaatggtaatttctgcaacaggatattgtatttcgccattttcaacccaaaaacctgcagctccccgtgaatattctccagtcacgacattaatcgcactgcctaacatttcggtgacaagtaaacctgttcccatctctttaagtaatgcagttaatccccctgtgcgattaggtttgactagccagttgtgaataccgcctgcgtgtcctgtcgtttgcatacctaattttttagcactgtatgtcgttaaaagataggtctgtaatgcgccatctttaatgatttggtgatcgcgagtgtaaacgccttcgctatcaaaaggtgatgaagcaagttggcgaagtagatgcggtttttcgttaatttcaaaccaagtcggcaaaatttgctcacctaacttgtcttgtaagaagctggctttgcggtataaagctccgccactaattgcacctgcgaggtgtccgataagccctgtggcaatgtcgttataaaaaatcacaggaacttcacaggttgccagtttttgagggtttaggcgatcaacggctttgactgcagcttgttgcccaacccattttggcgaggcaagttggtcaaattgacgagagatagtgtattcgtaatctcgctctaactgatcttcataggctgaaatgacgctacaagagagggaatatcggctagataggtagctttgtagcataccgtgtgtgttgccataaactctaatgcctgcgtgtgaattgaaggttgccccttcgctattgacaatgcgatcatcgctgtgtagtgcatagtgttccgcttcaatagccagttcaaccgcttgatcaacggtaatgtctgcttgatgatataacgccaaatcgggggcttggtatgccatcatttctttgtcagctaaacctgcacagtcgtcctctgaggtatattttgcaattgcaagtgccgattcaaccgcttgttgaatagattttggttgcaaatcggaagttgaagcattgccttttcgtttaccgagatagacagaaataccgagtgagccgtcgttgttaaattcaatattttctgtttgttctaagcgtgtagaaactgataagcctgcgactttggttacacccacttccgccgttgcacctgctttttgggctaaatccagtgcaatttcaacggcttgacgtaaggtttgttcttgagcttgaagttcttgtttggtaataaatgacataattttccttctataagcggtaggattagcgaaaatttttgtaaaactgttctcttttcacttaatctcgccattctaccctaaatttctgctaaactacgcaaattttgtaaaagaaaggaatagcaatggctagaaaacaacgtaatgagattgattggacagatgaggaagaagagatcatctgggtaagtaaaagtgaaattaaacgtgatgcggaacatcttaaaaaattaggggcaagtttgatagaactgaatagtgctaatcttgctaaaatgcctattgatgataccttgcgtgaagcaattgagttagcgcaacgcttacgtttagaagctcgtcgccgtcaaattcaatatatcggaaaattgctacgcaatgtcgatcacgaacctattcaggaagcattggataaagttgaaaatcgtcataatcagcaacaagccctattgcacaaattagagttaattcgagatgaactcattgagcaaggcgacagtgcgatcaatccgcttgtagatgaatatccgacattggatcgtcagcatttacgcaatttaatccgtgccgcacagaaagagaagcaagcaaataaaccaccgaaaaattatcgtgaaatttttcaatatttaaaatctacaattattgaacaaaattaaataaggacaaaattaatgcaaacgatcttttatactcatattggtttagcttacctcagcttaatgctattactggttcgcggattactttccgcaagaatggttgattggcgacaatataaactcttaaaaattgcaccacacgctgttgatagcttgttattactgtctggtgtgggcatttttgtctatttcgccatggattttcaaacgtggattttagcgaagttattctttttggtgatgtatatttattatgcgacaaaagccttcaagaaagagcgacctttttctctcaaacatttcattcttgctgtcgtcagttttatgatggtgatgatggtagcaacagttaaataaacaataaggcatagtattactactatgccttatctttatagatgaataaaataacttctgtttctgactctattttgcttttgagctcgcactgaatttcttggcataataaaataatatcgtttaataaaacgtctttattaaaatgaagtttcaaactttctccgctattcaactgtaacattcccctttttgccgacaaaagaggaagagggcaacggtaagcggtgagatcaagtgaataattcaccattaaacccgacggcgctctgccataatctgcccgattgagttgagttcttcttggcttagatgctctcgccctaattcaaaaagcggttcttcaatcgtaatatgttgatcgtaacctaccacaaagcgttggattaactcgcggtcaatgtgttgaatttcgccattgagtaaggcgactaattgggcggagagttcgtcccaattttgatgtaattcaatgtgttgtgcttcgagcaaatctacgtccgtttgcgcttctgggcgttgcttaatcaatgctgggaagaaatctttttcttcgtcatcgtggtgtaagggtgcagattgattgaagtaatttaagatctgctgtacatcatttttgaccgcttgatttaccccgtttttcgctaagtaatctggcaacagttgtaactgacggcagaaacttttgacctttccgtggcaagcataaagcatttcaatcggttcatcccaagtgacaaattcttgaggagttaaaatgtacatatagttatccttttgtgtaagtattacatcatcacatgtactggatattatatatagtaaataatcctaaattaagcctcaatcataaaaatgtgttactatctgaaaaataatgcgacctactgtggtaatgatttggctaaatcctattgagtacgtttgattccttccccctttttcccttttctgatataatcctgcctaattttcggcagattttgccgttgtcgatttaagttaatataggaacaacaatgtcagaacaaaatcaaccaaatagctatgattcttctagcattaaagtattacgtggtcttgatgctgtacgtaagcgtccaggtatgtatatcggagatactgatgacggcacaggtttacaccatatggtttttgaagttgtggacaatgcaatcgatgaggctttagctggttactgtaatgatattgtcgtgactattcattcggacaattcagtgtctgtgcaagatgatgggcgaggtattcctgtggggattcaccctgaagaaggagtgtctgcggcggaagttattatgaccgtattacacgcaggcggtaagtttgacgataattcttacaaagtatcaggcggcttgcacggggttggggtgtcagtggtaaatgccctctcgtccaaacttcaactgactattcgtcgtgaaggtcacgttcacgaacaattttatagtttaggagatcctgatgcacctttagcagtaattggcgaaacagaaaagacaggaacaaccgtccgtttctggccgagttatgatattttcaaaaataaaacggaatttgaatatgcgattttatctaaacgcttacgtgaactttcattcttaaattcaggtgtatcgattcgcttagttgatgaacgtaatgataaggaagaacatttcaaatatgagggtggtatccgtgcttatgttgaatatttgaatgaaggtaaaaacgtaattcacccaacgccattttatctttcaacagaaaaagatgatataggcattgaaatttcaatgcaatggaatgatagttttaacgaaaatgtatattgtttcaccaataatattccacagcgtgatggcggtacgcacttagcaggtttccgtggtgcattaacccgtgccttgaaaaactatatggaaacaggggcaaaactaaaaaaagaagatgccaaaattgatgcgtcaggtgatgatgcacgtgaaggtttagtcgctgttatttcagtgaaagtaccagatccaaaattctcttctcaaacaaaagataaattagtttcttctgaagttagaaatccattggaaagctcaatgaatgaagcactacaggaatatctattagaaaatccaaatgatgctcaaaatattgtgactaaaatcattgatgcagcccgtgcccgtgaagcagcacgtaaagctcgtgaaatgactcgtcgtaaaggcgcattggatttaggggggttaccgggtaaattggcagactgccaagagaaagatcctgcattatctgaactttacttagttgagggggattctgcaggtggctccgcaaaacaagggcgtgatcgtaaaaaccaagcgattttaccgttaaaaggaaaaatcttaaacgtagaaaaggcacgttttgacaaaatgctttcttcacaagaagttgcgacgttaattactgcattaggtgcaggtattggtcgtgatgaatataacattgagaaattgcgttatcataaaattattattatgaccgatgcggacgtcgatggtgcacacatccgtaccttgcttttgacattcttctatcgtcaaatgccagaattaattgaacgtggttatgtctatattgcacagccaccactttataaagtgaaaaaaggtaagcaagagaaatatattcaagataatacggaaatggagcaatatgaattagcattagccttagatggtgcttcactttacgtaagtgataaagcgccagcattaaatggcttagcacttgagaaattaattgctgaatataatgatgttcaaaaattgtttgagcgtttaacccgtcgttatccaactgctttactgaatgaattaatttatcagccagccctcacgacagaatttgtaaaaaatgaaactgaagtgaccgcttggaataacaaaattgttgagatcttaacagctaaagaaactagtggaagtacttatgttgcagaggtattttataatgcagaacgccatatttatgaacctcaagtaattgttactacacacggaattagcacaacttactgtttggatttcaattttattacaagtaatgaatatactcgtattactaaattaggcgaacaagtaagcgatctccttgaacctacagcgtatgtacaacgtggtgaacgccagcaatcaatagaaagtgttgccgaagccattgattggttggttaaagaatctcgtaaaggtttaaccattcaacgttataaaggcttaggtgaaatgaaccctgagcagctttgggaaacaacgatggatcctgtagcacgtaagatgttacaagttactattactgatgcaattgcagcagataaactctttacaacattaatgggtgatgaagtagaaccacgtcgcgattttatcgaaaataatgccttatatgcaaatttagacatttaatccctactaaattattttgtagggcgaatatctattcgtcttattcttttctactcagactgtttatttgaggaacaaaatgaaatacgaactaaaaaaacaaacggcaacgctcgtcgtggtcgattaactttttctcgtccaaagggcgaatatcacgttgaaacccctgcatttatgcccgttgggacttacggcacggttaaaggaatgacccctgaagaagtggcgcaaacaggcgcgcaaattctgcttggcaacactttccatctatggctacgcccagggcaagagattatgcgtcagcacggcgatttacacgattttatgcaatggcacggtccaattcttacggactctggcggtttccaagtctttagtttaggcaaattacgcaaaatcaaagaagaaggcgtttatttccaaaacccaattagtggtgaaaaagtctttttatccccagaaaaatcaatggaaatccaatacgatctcggctcggatattgtgatgattttcgatgaatgtaccccatacccagcgacctttgactatgcaaaacagtcaatggaaatgtcgctacgttgggcaaaacgcagtcgtgatcgctttgacgaattacaaaacccaaatgcgttattcggcattattcaagggggcgtttatgaagaattgcgtaaagtttccgtagaaaaactggttgaaatcggctttgatggctatgcggtgggcggtttagccgttggcgaaccgaaagaagatatgcaccgcattttagaatatgtttgcccacaaatccctgcggataaaccacgctacttaatgggcgtaggcaaacctgaagatttggtggaaggtgttcgccgtgggatcgatatgttcgactgtgtaatgccaactcgcaacgctcgcaatggacacttattcgtcaccaacggtattgtcaaaatccgcaatgcgaaatatcgcaatgacatctcaccgcttgatcctgaatgtgattgctacacctgtaaaaactacaccaaagcctacctatatcaccttgataaatgcggtgaaattttaggggcaagattaaacaccattcacaatttacgttattaccaacgtttaatggcagaaatccgccaagcgattgatgaagatcgctttgatgattttgttgtcgaattttatcaacgtatcggcaaggaagttccaccgttacaattagccaaagagggtgaaaatgcttaattaatttgacaaacacaatagtaaattgctgtttaaacttgcagagttacgttgtaaattttcttgatcaaagtaaacattgactatagattttctcaaattatcacaaggagatataaatgagaaagctcacatatctaacttcacttgctatttttacaagtgctttacttggttgcagttgtagttgtgaaaaaacgcaaaaaccacaggaagagaaaaaggatgatcaagcgttgtttgaggaaacgctaaaccctacgccccctttaccaacaagtctgttaaaactgcctggtccaccaacggtcaatttgttagcaaccagtccatcaaatactgccgaatttaacgactttatcagcattatgggacaaaatggggcggtgattacgatgtggtctgttgatcgtcgtagctggctttggatgtatccgccgcttaattctcaagattttggcaaattgcgtaattggcgaattgagcggagcttccgtcaagaacattttcgttttactaatcagcagatgggatcttgtatgcaggcttatggaaatggtgtgattcaagatagctgtgatccaaataatttagatcaagattttgagttactgccaacctcgacaggatcggtgttcattaaaagtgtttcccagcagcgttgcttaacttacaatgcggtgagtaccactggctattttacgctgactttggatcgttgtgatgataaacgtattacaccgttacacgatcaaacgttctatctcacaccaccattacttagtgctaatccattataggaggaaaaatgacgttatttaatcgagctatagcattagtatgttgtttacttcctcaaattgccttggcaaatttggaaaactatacggttgcaacgtggaacttgcaaggttcttctgcgattaatgaaagtaaatggaacatcaatgttcgtcagcttttgacggggcctcaagcggcaggtattttaatggttcaagaagctggctcattgccatctaccgccgttcatacacgccgaatggttcagcccgagggggttggctttccaattgatgaatatgtgtggaacttagggacaagaagtcgtccaaataatgtttatatctattactctcgcttagatgtcggggcaaatcgagttaatcttgcgattattgctcgtcgtatggcaagcgaagtatatgtgattaactctggttctagtgtattaacctctcgtccagccataggcattcgtattgataatgatgctttctttagtattcacgctctatcttcaggcggtgctgattcattaagtttgattcaaaatattcatacgttctttaatactgaggaaagacgacatatcaattggatggcagtaggtgatttcaatcgttctccaggcagaatgcaagaagcattaaacacagaaccaggattaagcaatgccacattaattgttgcaccaacggaacctacccatcgttctggcaatgtattggattatgcagtgttacacaatgcgaatcaaaccacacaaaacacgacggtcagtgccagcattatgtttaatcagatgagatcgcagattacctctgatcatttcccagtcagctttgtgaaaaaacgttaagggggaactatgttaaagcgttttactttattgatgacattaggactatgccagttttcccttgcagaaacaccaccgatgccacctgcacctacgccaacaccatcaacttatcctgatgttgttgaaataaagccccctattatctctttacgcagtttaaatacgggggagccagtatctaatcggagctacgatcggaatgatccaagagaggtgcagtggagacttgtcgatgctattgttaaaaatcgtcggttcgttcaatttcaagtatttggtaaagaaaatcgatgtttagttggagatggtggtactttaccctgtggacaaacagacactttatttaggttagtcccaaccgatacgggggcatttattctgacagaccccaatacgggaaaatgtttaaccagcgagaattatggcagttatggttttcaaaactgcttgcgaacttcttcagcagaacctagcaatattccgctaaaacatctttggatcattgctccgccttttgggcctagtaggttattataacattacaatttttaggggctaaattgattagcccttccattccaaatgatgtaagatgttgtttatacaagatttttttaaataaaaggcatagttttcacgaaattagcaaccattttgtctactatgcctttgtaaaattagtccatcaacattttaaatttactgcccctattctttgatgtacaagtacattatttagatgtagataccttcactacttttatatgaaataacgaattaggtgataatttataaatataaaaattatcattatttgcatgtatctcattagctaaaataaaagtatcgctatattttgccaatatataataggttttatgatcaatatctattatatcaaaagtatttttaaaattaggacgaatataacccgttataaaagcaaacattacaaaacagcaatatgtacagataattatatacacctgatttttatataaaaattgcatagttgctttaacagaaatacttggaatattatgatttatatagttcttaaatattaaagtaaataataatatcaataataaataacctaatccgacataagtgttacatcttcctattgaagcaatatagccaaatagaagaggacttagccctatgcaaatcaaaatatatgctcgtaaaaattgaatatacggttccggcatatatttcttagcttttattagaatatataatccaattaaataagtaagaaataaaatagccgtattccaaagcacatatcctaaacttctagcaacattactaattcccacatcaacataccaccaagggaaaccataaaagtatgactgcccccaaccataggcataagcaaccgaccacccagttaccccccaaaaagccattgaaatagaagaagaaataaatttattcgcaattttcaacataatatacctacaacttatgcggcaacttttgccaagtcacttcatttctcaaataaacaggttcaatatcaaacgccgactgtacttttccttgtacaaccttctcaattgccaaagataacatatattttgctgatggtaaggtaatctccgttactttgacagcgaggttagcctgctcaaattgtggataggctgcccagcctgttcctacaataaccgtattttgggtaggttgcatttgagcaattgctttttctggcgaacagacttgctctacaacctgagtttgccagccctgttctgttcgttcaaattgtgcaaaatagacctcattcattcgagcatctattaatgcaatcacactgttagcattcaaggtttgataagcctcttccgccattgtcagtaaattagatactggtacaacaggtaattcggcaccaagagctaacccctgagcgatcccaacgccaacacgcacacccgtaaaactcccagggcctcttccgaaagcgagaacatcaatctgttgcacagaaatccccgcttgtgtcagcaattcatctaccatcggcagaatgcgttgagtatgggttcttagacttaattcatcaataaatgtggttttaccttgatgtaacaaagccactgagcaggcttcagtggcagtatctagtgctaaaatagttttgttcataatgtcatataaagaaaataatgttgaactcgcttgaaaaaagcgagacgacataataccaattatttgcctaattgacggcgttttgctaccgcatcagcaagttggaatagcactttttcactgtcctcccagccaatacagccatcggtaatactctgtccgtaaaccaattctttaccttcaactaaatcttggcgaccttcaacaaggtgactttcgatcattacccctgaaataaggtgtgagccgttcgcaatttgttgtgccacatcattgcatacatctaattgacgtttgaactgtttttggctatttgcgtggctgaaatcaatcataacgtgcggacggcgaccagatttttcgatatccacacacacttttgcaatagagtccgcatcataatttgtgccattatcaccgccacgcaaaataatgtgacaatctggattacccgctgttgaaacaatcgcggaatgcccgaacttagttacggataaaaagtggtgaggggcttctgctgcgccgatcgcatctaaggcaatcttcacgccaccatttgttccatttttaaagcctacagcacaagataagccagatgcaagttcacggtgaacttgtgattcggttgttcttgcaccaatcgctccccagctcataaagtctgcaacatattgcggggtgatcatatctaaaaattcccctgcagctggtacggttaaatcattaatatccgataacactttgcgagcaatacgcaatccgtcgtttagtgcaaaagtttcgtttaggtaaggatcgttaataagccctttccaacccacagtggtgcgtggtttttcaaaatagacgcgcataattacttcaagatgttgattaatatacggatttgcacgcatttcttgaatttttttcgcatatgctaatgcggctttcgggtcgtgaatagaacaaggcccgatcaccactaacaagcggtcatctgctccgtgtaaaatacgatgaactgcttcacgagcggtcgcgactgtttccgctgcaacatcacttgcgggaaaacgctctaatagtgccactggtggtaacagttcttcaatatggttaatacgaacatcatcatttttatacattgtgttgcccactttattgctcattgctataaatccttatgttatataattgttattctttctaaagtaaaagaatgccataggtttgtcaaatactccaaacacctttatctcgccagcacttctcgcttgcctcgactatctggagcagaaataatcccctgttcttctagttgatcaataattctcgctgcacggttaaagcctagtgagaagcgacgttgtacgccactaattgaggttgccccaccgtcaatcataaattgagcaatttcgtcaaacagtggatctaactcaccgcttgtgcgttctgagttttcgccattttcatcgccttctggtgctaccacaatgctttcaatatattctggtttacctctcgctcgccagttatccgccacacgctgaacatcttcatcggtcataaatgccccgtgaacacggatcatttcagggctgcccgcaccagaatagagcatatcgcctcgccctaataaagattctgctccgcctttatctaaaatggttcgagagtcaatttggcttgccaccgtaaatgcaatacggcttgggatatttgctttgatcaccccagtaatcacatcagttgatggacgttgtgtcgctaaaattaagtgaataccgaccgctcgtgctttttgggcgatccgcataatgtgatcttccacctgtttacctgccgacatcattagatccgcaaactcatcgacaatcaacacaatgtagcttaatttttctaatggtggtggcaaactatccattgtatcgccaggtcgccacaacggatttggaataggcagatccattgctgccgcttgatcgattttcgcattaaacccctcaatgtttcggacatttaaactactcaccagtaggtaacggcgctccatctcctccaccgcccaacgcaacgcattttcggcttttttcatatccgtcaccaccggggtcagcaaatgcggaatatcgttgtaaatcgacagttcaactactttcgggtcgatcataatgaagcgaacctgctcaggcgatagcttgaacaataggcttaaaatcatcgtgtttactccgaccgattttccgccccccgtctgccctgcaaccagtaaatgcggcatttttgccatatcgaccacaatcggcttgccgctgatgtcttttcctaatgccatcggcaatgtcgctttggtatggcgaaactcattgctatccagcacatcacgcaaccaaactgtttcacgctgacggttaggggtttcaattcccatataaggtttgccggggacaacatctgtaatacgaatggcttcaaaaatcagcgaacgtgcaagatctgaagctaagttggtaatcttcgccgctttcacgcctgctgccggtttgatttcatagcgtgtcaccacagggcctaccaacacatcttccaccgttgccctcaccccaaagttcgctaattcacgctcaattcgagctgaggtatctcgaatttcttgctctgtaatttgctgttcttctgatttcactgtcgtcaataaatcaatcgtcggcaacggcgtggttggcttttcgacctttctcttagtttgtaacaacgggtgaataaggctatcgccatagcctttcggataagttacgcccttcttttcaggctgtgcctctgctgttgctactttaggttcaaatagcggtaggttttcttgtaaaaattgcacagttgattgtgcttcttcaaacggctctactgtaggctctgccgccacttccaccacagggtttaaacgcacctttggcattaccggctcagtaacgtttggcataatcactgtttcttccggcgactcaaaggaagttgatacagaaggaactgcaacatcaaactctggaacagtaatgcttggcaatgaacttgggttctccactttaaattttgttacatcggttaattcaacgtcagctgcgacttcttcctcttgaacggttttcaagcccgtaatatgcggacgagtaaactgagaaacatctgtgtattgtgggttatctacggtttcttcgctttcactctccgcttcgactttctcctcattttcctctgtttgaacagcctcgtcagtatttaacgtactcggcttatcttcggtttttccttccacgatccaatgatacaagcggttaaataattgcaacaaaatctgtcccgaacaaaaatagaaacctaccgccgttaatagcattgcaacgagcaacaataccatttgagaattgagccaagacgctaacattcccccaataaaaccacccgaaagatagtaaggggaattttcaaacaatacgctcgacaaccccgccagcccgactaaaaataagaaaaagctccctagccaaaacccaattttcgcccagtttagatcgtcagctaaccgtaaaatcaatacataaatcgacgtaaatgccagcccaaaaggaacaaataccgcaactttaccaaacatcgcaaagagcaaatcaactaaatacgcccccaatgcccctgttttatttaatgtttcgtgggtaatagaacttgccgtactccaagcattatccaacggactataactcgcccacgccgtgatcagataaatcccaaaacacgccgaaagcaacaacactaatctaatcaggttctctttcccttttaaacgatcaatcacagctaatccttatttcaaaagtagatagttagtttgcttcacttcttccatcaccacataggtacgagtgtcgttcacccccggtaaacgcaacaacgtcgttcccaataatttacgatacgccgccatatcagccacacgggttttgagcaaatagtcaaaatcccctgacactaaatgacactcttgaatttcatcaagttgctgcaccgcccgattaaattcctcaaagacatcaggtttaccacgaacaagagtaatttctacaatcacgagcaaaggggcttctaataattctggattaagtaaagcacgataccccattatgacattctgtttttctaaacgtttcacacgctccaaacaaggcgttggcgaaagcccaacacgtttagagagttcaatgtttgaaattttgccattacgttgtaattcattgaggatttttaaatcaatagcgtctaaggcttttgttagttttttattttccatttgaagacctttctagcggattgttctaaaaactccattctatcacttctttttagagggactaaggctatttgcaaaaaacaataattacagcaatcatcatctacatacattattgtctcaccattcttaaattttctggtattccttcaaaatttgagcgaaaaggattaatatctagccctccacgacgcgtataacgagcatatacagtcaacttttgaggctgagcaaattccattaaatcacaaaaaattcgttcaacacattgttcatgaaattcgttatgttctctgaacgaaactaaataacgcagcagtttctctctatctaattgcttccctacataacaaatttgaatacttccccaatctggttgagaagtaatcaaacaattagatttcaataaatgacttactaatctttcttctacaatttccccatttgcaataccttgtaaggactctcttgtaaaatcataacgattaatacagatgttttgattatctatacattctccattaaactcagaaattgatcgcatagcaaaatcagataatttataaatttgcactgtgacatctccttgggcacatttacttaaatcagactgaatacgtctttgtacatcttctcttgaaggaaaacgcatttgattaaaactattcaaataaagtttaaaactttttgactcaattatatttgaactactactatcaataataacatctgcaattgctacttggggcactccattttgattaagccatgaaagttcatagagagtccaaatatctgctcctaccgtaaaaggttgctgtttaacaatacctaaactctctctatttaaataacgaggtaccgcttgtaacaaactaggatcataagtacttttatactctgtttttttttccaagttttaacatggaaagacattcattattgtaattcattttaaatccctcactcttacatcaaaaatcgttgccaacaagttgctacatactgacgttcatcaataaattcgctgccatcaacaatactctctttattcaataaatttaaacgatgaacttgatcgcgtaaacccgtataacaccctttcaagcgttcaccttcatctgcagttaaaataccacaagccactgcgctgtcaaaaatacgaacattgtccgaccaatccgccatttgtggatattgatgggcatagtttaacacaagatactgagcaataaattcaatatctgtaatcccaccttgatcggtttttaaatagaactgccctgcggtagttttgctcagatggtgatacattttttctcgcatattgcgaatatcttctcgtaacgaaccgcttgaacgctcttggcttaaagtttctcgccgaatttgctcaaatttttgtcgaagttccgcagtgccatatactgcacgagttcgcacaagggcttgactttcccacgtccacgcctcgtgtttctgatagtggttgtaagcattaaaggtactcaccaacaatccagcttctccagagggtcgcagtcgcatatccacttcataaagcacgccagcactggtattcaagttaaaaataccattaattttttgggctaacttaagataaaactggtggcttgaaatagatttttttccgccaactgtttcgctctgttcaggggcattatgtaaaaacaccagatccaaatctgaattataaccaagctcaattccccctaacttgccataagcaatcaccacaaaatctttctcgccgttttgtaaatgttcaggctcaccaaaccgctgtgccacttgtcgccacgctaaattcaccacttccccgataatagcttctgccagataggttaggtgatcgctgattttcatcacgggcaatacccccaaaatatctgcccctgcaatacgcaataaatggctctgtttaaactggcgtaacccgtcaatcaattcttcttcgtcgtcctctgggatacgcaacaaatactctcgcaaggcttgaggataagtctcaagcggtaagatcgtcattaaactttgctgaaaaataaactcatcaagcaacatcggataacgtgcaatttgctctgctaacattattgattgcccacacagttgcaatagttgaggcaaaatctgctctttttctaacaacaattcaaggtaagtggtacgcaaggtgattttatctacgatcttcaaaatgcgtggtaataacagtaaataatccgcctcgtgaaaaatctgatccaacactttcggcatcagcttctgtagcacctctcgccctctcactccaatcgggcgtttcacccactcttgtagagtggttataagctgttggtagatctccctatgagcttgagttgctacaggataggtcgcaagaacagtagctaaatcctcttgggtaagttgtacatttaaaatatctcgccattcggcaaattttgggttttcctcaccgctttcctcactgccgtcctcaccaatcaattcattaaaaatcgctcgaacattctgctggtgttgatgtagttgcaataaaaagctttcccaatccattgccccatttgcaaccgccaacctcgcccgatccacttcatttgtcggcaaggtttgtgtctgttgatcattaattgcctgcaacacattttctgtgtgtcgcaaaaatagatacgcctcacgcaaattattcacctgcgtttcgctcaacaaattcaactgagccaactgtggcaacactgccaacaaacttcgttgctgtaaaattttatctcgcccccctcgcatcatctgaaaggtttgcacaataaattccacctcacgaataccaccagcccccagcttaatgttatctaccagctctcgccgtaacacctcacgactaattttctgcttcatctctcgcaacgactggatcgcactaaaatccaaataacgacgatagacaaaaggacgcaacatctgcttcaaatacttatggttaatgttcgtcagatcttcgcctaaaattttcgccttaatcatcgcatagcgttcccaatcacgcccctgctcttgataataatcctccatcgccgtaaaactcagcaccaaagcaccgctatccccaaaaggacgcagtcgcatatctgttcgataaacaaagccatcaagggtaatttcgtctaacgctcggatcaaccgctgtcctaaacgagtgaaaaacttactgttttccatcggcttcctaccgcctaccgtttccccaacatcaggataggtaaaaatcagatcgatatccgacgaaaaattcagctctcgcccccccagtttacccatacccaaaatcagcaactcttgcttttccccaagctcattcatcggcgtgccatattcgccacacatctgctcaaacagccaatccctcgcccccaaaatcaaggcttcagctaaatccgacaaccgctcaaacacctgctgggtcgaagctcgctgattagattgaataaaactcaaggttgccatttcacggtgacgaaaacgacgtagctcacgctgtaattcttcttcatttttcaccgtagaaatcaccgcttgcaaccgctctgcataacgctcacaatcctcaatttcaggcgatttttcaagccaagcggtcaataattccggctgtttttgcaactgttgtgccacaaaatccgacatcgcaatggcgttgataagcggtaggatttgggggaaatgttgcggatgttcgggaatttgatgtaacgtcattaacgtattcaatttcatttcagcttgagcaaaaagagaattaaacataagaggatctcaaagttgggtggtttggggttattgtacggggaaaacaggctagtaacaaagatatcataaaagtgaaatacataaaccttatcccaaatatattaaagttaagacatacatttattcttcattattttttaattcacatgctttcattgttaaaagagctttttccaatcactctttttcgcaaacgccactctattttccgtatgtttaattcgggtaaagctaatttcccacacatcgctactcatcaattttgcaagtggatgcttttgccaataaatttgtaaagcagtttgtttttcttgttcattctcaagacaacgagcaacggcttgaaattgaatgccttcaatctctcgaatgttgtcgggttgccctgcaatagtgcctgtaatgttggggttggctaacatcaatttgccgtgttcggtagtttgctttgacagcacgatcaagcggtgagatttttcatcaaatgcgtaaaagcaactggctgaccaaagctgattttgatgatggcacgcaaggctcacaacgtgatttttcaagataaattgcacaatgtgcgtaggaattggattattcatctactttcctgtccagcgtggaatatcaatctcaagatcaaacatatctaacgcacgagcgacgctatgggtcacaatttcatcgaccgttttaggctgatgataaagtgctggcacgggcggaaaaataatgccccccatttcggtgactttacgcatattatccaaatgggttaagtgcaacggcgtttctctcaccattaacaccaatttacgtcgttcttttaacactacatcggcggcacgagccaataaattatcgctaaaaccgtgagcgactgacgctagggttcgcattgagcaaggggcgataagcattccaatggtcttaaatgaaccgcttgaaatagaagctcctaagttatggatagggtgaactacatcggcaagggatagtagctgttcttcgctgatgttggtttcatattggcgagtgagttccgccccttttgaaatcaccaaatgggtttcgatattgtctagcggtttaagcaattcaagggctttgtagccatattgaaagccacttgcaccgctaatgccgataataatgcgtttatttaacatatttttccttgtaggtcgggcatttatgcccgacgtttatgtaattggttttatattgattttatggattgtaataattgtcgggcataaatgcccgacctacttcagaaatacttgaaaaaaatagcaaactggttactatgtgccgctttattttgtttaatccgaatttgttaaattatgcaccaagaccatgttcaagacacgcaaaaagagaaaaaaattgcctataacttcaataaattgcaaaaacgcttacgccgaaatgtaggcaatgcgattgcggattttaatatgattgaagatggcgacaaagtaatggtttgtttatcgggtgggaaagatagctatactttgctggatattctgctcaatttaaggctcaacgcccctattcattttgatattgtggcggtgaatttagatcaaaaacagccaggcttcccagaacacgttttacctgagtatcttgagagtatcggcgtagagtataaaattgtcgaagaaaacacctacggcattgtgaaagagaaaattcctgaagggaaaacaacttgctcgctctgttctcgcctgcgccgtgggattttatatcgtactgccacagaactaggtgcaaccaaaatcgcgttaggacatcatcgtgatgatatgcttgaaacactttttttaaatatgttttacggtggaaagctcaaatctatgccaccaaagctaattagcgatgatggtaaacagatcgtgatccgaccgcttgcgtactgcaaagagaaagacattgaaaaatatgccgtggcaaaacagttcccgatcattccgtgtaacttatgtggttcccagccgaatttacagcgacaagttgtgaaagagatgttgcagacttgggatcgtcaatatccagggcgtattgaaacgatgtttagtgccttgcagaatgtggctccatcacatttatgtgatccaaatctctttgattttaaaggcattaaacgtggtcagctaattgacggtgttgaaggagatattgcctttgataaagcagaaattccgtctgctcctgtggttcaagataaagatgatgcagcagattatgcggaaagcggtttaattcagattaaagcggtgagttagtcgaaaaaatctgcaaaaagcgaaataaacgtttgcttttcatttttttctaggatatatttcggcacattcaattttggagctactatgaacattctctcaaacattcgtcaccgtcatcaccatttacctgaataatctttcgggcatttggcgtgttcggaagaaacttccgagcggtgcaaaatgagagtagatctaaaaaccaatttccaccccttcggaagatgatttcgaaggggttcttttttatctcgtagaattgaataataggtttatttttttattacattaagaggaaaacacaatgttattatcaaacgatgtggtcatctcgattatcgtgttactcgcattaagtttattgcgaattaacgttgtaattgcgttgattattgccgccttaacttgcggtattttaggtaattctggcaacggaatggcattaggtgaggctttaacgacaaccgtaaaaagtttcactggtggtttaggcggtggtgctgaaactgcaatgaactatgcagtattaggtgcttttgccgtcgctttatcaaaatcaggtgttaccgatttactggcatataaaatcattaaagcctttggcaaacgtccatctggtcgttcactgttttggtttaaatatgcggtactctttacgttagttgccttcgcaatggcatcacaaaacgttattccagttcacattgcgtttatcccaatcgttgttccaccattacttagcgtaatgaaccaacttaaaattgaccgtcgtgcagtcgcttgtgcattaacctttggtttaacggcaacttatatgttaattccagcaggtttcggtcaaatctttatcgaaaatatcttggtaaaaaatatcaaccaagcagggcaaccatttaacctagtgaccaacactgcagaagttactcaagcaatggcaattcctgtggcgggtatgatcgtgggtttattattagcgttctttgtaacctaccgcaaaccacgtgtttatgtggaagatcgcccagaaccaaccgctgatgatattgaagctcgtgtagcaaatgtgaaatcattccacatcggcgtgagtatcgcagcaattgttgctacctgttttgttcagttatcaacaaactcaacggtattaggtggcttagtcggtttgattatctttgccgttggcggtgtgttcaaacttaaacaaagcaacgatattttccaagatggcttacgtttaatggcgatgatcggctttgtaatgattgcagcttcaggctatgcaagtgttgtaaactcaacaggtggcgtggctgaattagttgaaggcttaaaagactcgatcggaagcaaaggtatggctgcattcttaatgctcttcgttggcttattaattaccatggggatcggttcttcattctcaacagtaccaattattacctctatctatgtaccattgtgtctttcattcggtttctcaccgcttgcaacagtatcaatcgtaggcgttgctgcagcgttaggtgatgcaggttcaccagcgtctgactcaaccttaggaccaacatcaggcttgaatgctgatggcaaacacgaccacatttgggattccgttgttccaacctttatccactacaatatcccgttattagtgtttggttggattgcagcaatgattttataggaaattcccccccccccgtttttttcaaagggggggaaattttgttttaatttggatcattttctctcattaaatcccctttgaaaaagaggcatttagagagatttaaaggacaatatgaaattcatctcttttaatatcaatggcttgcgagcaagaccccaccaactcgaagcgcttattgaaaaacatcagcccgatgtgatcggcttacaagaaatcaaagtggcagatgaagatttcccttacgatttagtcaatcaccttggctatcacgtttttcatcacggacaaaaagggcattatggcgttgcacttttaaccaaaaaccaaccgcttgcagtgcgtaaaggttttccaacggacaacgcagatgcacaaaagcgtatgattatggcagatcttgaaaccccgttcggaacgcttaccgtcttaaacggttatttcccacaaggcgaaaaccgtagtcacgaaacaaaattccctgctaaagaaaaattttatgcggatttacaacgttatttagaaacagaactcaagcctgaaaatccgattgtgattatgggcgatatgaacatcagcccaacagatttagacatcgggcttggcgaagtgaaccgcaaacgctggctgcgtgatggtaaatgttcatttctacccgaagaaagagagtggctagggcgtttacacggatacggtttagttgatactttccgagcaatgaacccaacggcagaagataagttctcgtggtttgactatcgctctaaaggttttgatgataatcgtggtttacgcattgatttagtacttgcttcaacccctttggctgaacgctgtgtcgaaacaggcattgacctagaaattcgagcaatggacaaaccttctgaccacgcacctgtgtgggcggtgtttaagtaatcatttaatagggtggcttgccaccttattttttatcctgttacgactcatttttccatttcactaatcgctcaataagatagagcaattctgatcgttgctgactatctaattgttgtaacaatttttcgataactttcgcttgatcggtcgaacggttactgctttcggtcactaaatcagctacttcacaatgaaaaatctccgaaagttccaacaaacgcaaaacagttggaattgttttgccccgttccattcttgaaacagcatcattactaatgcctaaaatttccgctaattgcgcttgcgttaagcctgatgcttgacggtatttcgcaatcgcttgcccaatcgtttgtattaattgctcacttttatctaacacacgatttctccctttataaagaaagaaataataggcattgactttttttgataaatagcgaataatacttatattagacttcaaaagtctaaataaaataaaagagcaaatttatttaaaaatttttataaaaatctgatttttttgttgagctgacacaacctgtcgtcaccattcgggtacactgcacgcattcaaaatcagaggatttagatgtatgcaaaagaatactgttctagcacaacgacttagtgaaattttatcccaactcaatcaaggaaaacgcattgatattaatcaacttgcagaagattttggggtaagtgttcgcaccattcaacgtgatattaaagatcgtttagcctttctcgaatgggaagagagcggaccacgacattacaaaatcaaccgttataaactaggtatactatctcagcaagacatctctcgttttgcgttatttgccagtatttcagaccttttcccaaaggtagatcgcgatttttatcaagaaaaactcaccgacagcgtcaaagtgaaaggttttcaatatgaagacattcgccacttagacaacgaatttcaactgatcaaacaagccattgaagcacataaatttatcgattttttatataagaaaagcggtcagattgatggcaaattttacaaaatcgccccttatagcctaatcaataaaaatggcatttggtatttaatcggcacagatgaagacaaacagaaaacgttctgcttcactcaaatcacaatgctcaagatgcttgatgaaactttcgaaccaaaccaacagctacaagaagagatcaaaagtaacgacagtatctcttttggcaatcagctcagtgaagtcttagttaaagtatccagctttgcctccccttacttccttcgacgaaatttactgcctaatcaaaaattagtgcataaatcggaaaacggcgaacttattttagccagcgaaaacgtaaacgaactcgacatcgtaccgcttgtgcaatattggattccccatttaaccatcatcagccctaacggcttgcaggaaaaaatggtggagaagttgaaacaatatattgcgaatgattagggggaaatatgaaaaaaattgatattagcgagccattttcaaccattaaagcattaattaatgaacgtcaaagttttgaaacctgtgacattgatgcaggtaatttattcgcctttagtcaagaacttgaaaaatatattgaaagtttaaatttgaagtgtcgcctttataccaaaaatcgcttagccgtaggcttatcagcggtattaaatccccgttggggcattttatcccttgcagcaattgcagcacataatttactgaccttaaaccccgactgtgagatctatcgagatcttgcgaataaaagggttggggtggtttggaagaaaaaattttcttcgtaaaaaatgtttttaaaggaataagatatgatgagtaagtttggcgatgaatcaaaaccaattaatggctttttttaaatataaaaagcgtatagaagatatgacaccagtagagcttatacaacgtggttggccttttaatattttcaaaaatccaacagaagaaacgaagctagctgcagtaaaagtggatggttgtgctattcaatatattgaaaatccaacagaagaaatgaagttgcttgcgattaaagaaaatggttatgctattcgatatataaaaaatccaacagaagaaatgaaacaagaggcagataaacaggaggatcctctatgtttttataagggaaaataaactatatagatatttaaatgatctattccgcaatttttataaaaaaagaaacgatgatttagtattttcactaaagtatttctatcttttgtaacaattgctatataaattactgaccttaaaccccgactgtgaaatctatcgagatcttgcgaataaaagggttgggggggagtggaataaactgtaattattaggagaaattttatatggcttatgtctatgatgttgatttagagtttttagctcaatgtacaaacgaggatctacaacccttagtagatattttaactaaggataaagatggtaaaaaacgttatacggagggcttaacaagctctagagtttacaaagtattttaccctgatcataatctttattggaaagagattgcagaagaaattcagaaattcggagcaaatactattgctacgttatttagactagggaaaggggtttcatataaaactattcttattgaagtttgtgaaaaaatgaaagtaaatttcaataaagaaagttcaaccgaacttattgaaaaacatttattggataaagtattaactagtgctatcgaagagctatctgaagatgatttaaaaaaattagcagaagaattaaaaattccagctactcatttaggtaaacaatctttaacggctcttgttctagttgaattaaattctcttttatctaccccagttctttggaagactattcatacaatgtttcctcaaactatcggtacactattagcaggcacagccttagggcgtattttaggctttgccacaggtcctattggttgggggataacaggaatttgggcattaaaagatatttcaggtcctgcaactcgcgtaacagtacctgctgtgatccaaattgcatttttgagaaaaaagtattctatcaacaattaaaccaacacaaacaacaggagaaaaatatgtttgtacaaaatttaacagcagagcaacaatctgcattaatttacttagcccacgaaattgcacgagcagatggctcttcagatgaattgcaattaggtatggtagagattctaacaaagcaatcagaagatggtgtaacagaaaaagcaattacagttgatgaacttgttacgttatttacaacggaaagagcaaaatgttcactattacttgagttattaggtgttgctcacgcaaatgaagaatatcatttaagtgagaaagatatgattgctgggtatgcaagaaaactgggtatttctaatgaaaaattaaatgcactagaaagctgggtagaaaagcaatttgctttatctagagaagttacattattgttagattaagcataggagtttattatgcctttaccgtttattttggctggtgctgctgccgtgactataggaacaggaattaaaaaaggaattgatggttttaaagataattccgctgcaaaagatattactgaagccgccgaaagtctttatgatacagaaaaaaagttatttgatgagcaagatgccgcaactaatgcatcattggaatcattaggtcaattgcaattgtccataggttcagactttgctgaattcaaacgcatttctgaattgctattggaaaaattagctcaacataaggaagctaaagacttacaaattaatattcctaaaaatgaattagataaaattgaagggattgctttttcagctgtcgcctatttagggcaactagctggaggggctgcaattggtgctggtgctgcttatgctgtttacggtggtgtaatggcattggctgctgcttcaactggcactcctattgcagccctttctggagctgccgcatataaagctaccatggctgcaattggtggtggtgctatttctgctggtggctttggaatggctggaggtgcagcaattttaggtggtggtgttgtagctccaatagtattagttgctggcttagcttttgcaaaacattcggagaaaaaacttgaatcagcaagagattatcgtacacaagttaaaaatgcagttagtagtatgaaacttggtcgccatcatttaaaagaaactgaggaatattcaaataagatctataaagaacttaatcgtgtttatcagatttttggtcaatatttccaagatcttaaaaatatggataccttagttcgtaatggagttgatatcaataccatctcatcagcaattattaagattgttgataatggttataaagtagcagctattttaacagatattattactaccccattatttaaacctaaaaaagatgataatggagagttagttaaaaacaaagaagatactgttgaatttgaaacagataaagatggtatgaaagtcattaataaagaagatattgatgcgcatattacgttatcaacatataaatcaaaagattttgagtaaattatgctaggcgagaggaatctcgcctttttatagggagtgaaatatgtcaaatgtacttatgactaagcctgaatttgattggacaggtgaattagaaaaaacggtagtaaattcattagtcactacttttggtttagatttcttgctttttgaagataagcgtggtggagatgttgatactgttcttaaagcacgagaatatcaaaaagaaattaaacaaaaggggagttcaacaatccatgtttcaaatgaacttgctagtcaattagattctaatggaagaaatatagatccttataagaaagttaaatacgatcaacagggaaatgttcaaaaagatggtaaaggaaaagtaaaaaaagaagatgattatcatggaaaaagtacattatatacaaaacgaaaagctaaagataaagaacaagaagatttaggaaccatggttgatggttatactggagagaaaatcaatgcagatgatatcaagaaggaacgaaatgggaaagaatttgagtatgttacagaattagatcatgttgtcgctgcaagtgaaatacacgatgatttaggtcgaatactatctggattagatggcgtagagcttgcaaatagcgaagataatttagtttctacacactggattataaataatgaaaaaaatgatcataactttaaaacctttcttgaaaaaggtggcgttagagatcaaagagttgagaaaatggcacaagagattacccaaaagaaatctgaactgaataatagtaatctatctcaagaagaacgagctaaaaaagaaaaagagctaagaatcctagaaagaaaaaaagaaattttagaaaatcttgatgaggagcaatgtcgtaaaatagaaaaagatgctagagataaatataataataaaattaattataaatattatacaagttccaaatttttcaaatcaacagcacttgcagcaggtaaagctggtttaaaaatgggaacacgtcaggcattaggtttagttcttgcagaaatttggtttgagttaagagagagaatacctgagatttatcaaaatctaaaacaaaactttacgattacaaagtttttagaaaaaattgctaagacattaagtaatatttttgaacgtgtaaaagaacgttttaaagatcttttaactgcatttaaagatggagcaattgcaggcttttttagcaacattagcactacagtaatgaatatatttcttgtttctgaaaaaatggtggtaaagctcattcgtgaaatgtggaatagcattgtaagtgtaattaaactaattacttttaatccagataatcttaatgcaaaagaattgtttaaaggcgtattaaaaatacttagtgcaggtttatctgcattattaggtacaatgttaaactctcatctaaatactattcttatttttccaatgggagatttaatagcagcatttgtaagtgctttagccacagggcttatgacgtgtgcttttgcatattttattgaaaatggattatctttcaaaaagttatgggaaataattaattcatataaaaataagtatgaattaatgacagaacatatgaaggaaattaatgcagagcttgaccgttatttattagaatgggcaaagattgaatttaacttaaatccaaatgaaatagcagtatttgtagatagccttgaggcttgtaattccgaattagaacgttctatagtgttagaaaaagagattcatcgccgaaatatagaattaccgtatgaatcaggtaatgagcaaagtactagaaattggttagctagtttagcagtcaaatgagttctttagcttctttcccctgcaattcctgtggcaaatgctgtcgccgagtgaatttaagtgaacaaaccgcttatttagatcgtggtgatggcgtttgccatcattttgatgaacaaactaatttgtgcaaaatctatgaaaaccgaccgcttgtttgccgagtggaagattactataaagcccatttatctcatctgtatagttgggaagagtttgttaaattgaatttagaaatttgcaataaactttaaaccaaataagaaataggaaataatatgaatttttttgatattttagggcgagtagccaaggctattagccgttctgtaggaaattctatggaaaatcacataattgaactttggaataaattaaaacatctcgacaatgaccgatttatttcatttataaattcaaaggatacattaaatactcaggtgtatatatctgttttatctatatattccaagagtatcaattcttattatgatttcatttatacaataggaaaaaccaagtataacaaggatgaaataattagaggaaccttgcgtatatgtaaatctaatattattcaactatctaataaaagagaaatgaatgaaattagacagatagctaataaatttgctactgaattttcataagtgcatagttagtatttaatatacccattttaccaaatgtaaggataagaaaatgaactttgaagaacaacttgttaaagaagtcgttgctcgtatgacggaagaagaaaaatgggaaacattcaaggcacttcaaaagtttgattttgatgaaatggatagaatgtttgaagaatacgataaaaaacttagaaatattgaacaaacactcaggaaaagtgaacagctcttggaaaaaatgaaagctgaacataactctagaaaggtgtaatagacaacatagtcgctaaaaactggctcaaagccttatagtataaggctttaaagagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatgatgaactgaccgaccatcttggttatctaaaacgaagattcagctttgcattgtgcatttagtgcgtaacagcgtgaaattcgtttcgtggaaagattacaaagccgtcactgcagatttaaagcaggtttatcaagccccgacggaagtacaagctcgcgaaaatctgaccgcactttcgcaaaaatggcaggcaaaatacccgcttgtaaagatgcatcaaaaaaatggacaatgccgattcagaactggaaactggcgatgaatcgatttatgattgattttggtgatcgcctagacgatcaccgttaagttgaaatgggtgtttacacagaatttgggatagggtcgttataagttatccccaataatttgacaatgccctctaatttcctctgtggaaatttcagtcattaatttatatccaaaatacttcttaatttccctttcgtaagtcgcaagtcttaatgctcttgtactttccgcaaaatcagtttcggcaatatatttaagtgcaaacgcttcaaaattattcgcactttttatttgatttttcttcttccgtttttctgtggctggagaaatcccatcactcaccattttacgagccatcattagcttttctcttgcttcaacaagagatatgccgtcctttccatattttcctattgttaatgtttctcttcgtccgttaatacgataatcatacctaaacgtaaccgtgccagcaggagatacaacaacgtacaatccatcacgatctgctactttataagccttatcctttgcttttaaagatttaattttactatctgtcagcattcttcccccctattttaaaataccgtcaaattaatgacggtattttgatattaagggataaacagctcaatccttaccgacaatttttacgcaaaaaaaattgaaatactatgaaaagctgtgaataggtgggatattattcccactctatcgtagctgggggttttccgctaacatcatacaccacgcgagaaatcccgttcacttcgttgataatacgatttgagattttacctaatagatcataaggtaaatgcgcccaatgtgcagtcataaagtcgatagtttcgactgcacgcagggaaacagcccaatcatatttacgtccatcgcccattacgcctactgatttgactggtaggaacacagtaaaggcttggctgactttgtagtaccagcctgaggcgtgtagttcttccataaagatcgcgtcagctcggcggactaaatcgcagtattcttttttgatttcacctaacacacgcacgcctaagcctggaccggggaatggatggcggttgagcatttcagctggtaagcctaatgccaagccgattttacgtacttcatctttgaacaattcacgcaatggttcaactaaaccgagtttcatataatctggcaagccgcctacgttgtgatgcgatttgatcacgtgtgctttgcctgttttgctggcggcggattcgattacatctgggtaaatcgtgccttgtgctaaccattttactgaagtgagttttttcgattcatcatcgaacacatcaacgaatactttaccgatagttttgcgtttcgcttcaggttcatcaatgcctttgagtgcatctaaaaaacgggcttcagcgtttacacgaatgatgttcaagccgaatttatcgccgaacatctccatcacttgatcaccttcgtttaagcgtaataagccgttatctacgaatacgcagtgcaagtttttgccgattgcacggtgtaaaagtagtgcggtaacagaagagtccacaccgcctgataagcctaaaatcacttcatcatcgccaacttgggctttaatgcgagctacggcatcttcaatgatgtttttcgctgtccattttgtttcgcaaccacaaatgccgaccacgaaatttttcagtaattctagaccgcttttagtgtgagtcacttccgggtggaattgcacgccatagaaacggcgactttcgtccgacattgctgcaatcgggcaagttggggttacacctgtgatttggaagtttgacggcaaacgtgtgactttgtcgccgtggctcatccaaacgtcaagttttgggttacaagcggtcagatcatcgtttaattttgcaaataaactgtcagttgcttttaactcaacagatgcatagccaaattcacggtgatctgaagtttccgttaaaccacctaattgcatcgccatggtttgcataccgtagcaaataccaagcactggtacgccagcgttaaacacatattcaggcgcacgtgggctgttttcttcggtggtactttcaggcccgccggaaagaataatccctgttgggttaaattcacggatctgttcttccgtcacgtcccaagcccaaagttcgcagtaaaccccaatttcacgcacacggcgtgcgatcagttgggtatattgtgaaccgaagtcaaggattaagattttgtggttgtggatgtttgtcatttttagtcctagtttatatattcaaatagctacgaatctcatctgttaatttaatgaaatcatcattttgttcatttatttgctgaaataaattaagtattgattgttcaatattttgtgaagtcattttaacttcatatagataaaattcagttaatttaatatctgcaacaaaattatcaatttcttctcgtaatttatgtgataagaacggctttattttttctaatgaggcaattaacttatatgaattaggaatcgttttttttatgttgattaaaatttcattggtgtaaaagtcctctttttgttcttttaacttattaaaatcaatatctgaaggaaaactcattgagaaatttgtagttttagccactttatttatatctatatctttcatagctaccttatatgtgtaatacatatccatcgatatgccatctgtagcaatagaaggaataaaagtttcataatatgcttctataatactatctaatcgagatatatatctggcatcttgccagttgttgtatgtgaatattgcagctgcaatagttgctattgcgatacatgtatttaatacatttggataaaaactactggatttttgtgataagccttcggctaatccttcactataacccttataataattatctctattacaaaacataatatctttccttatatatgcaagcgaccaaatttcagaaaaaacttgcagattccaaccgcactttatttcaacttctttttactttctgcaatcattttcttcgccgataaatcactcacgacttttttacctgttttgctctctaactcttgtaaagccactttagcaacattgccaccttgttcggcgactttttgattttcttcaaaggtttcaggatttactgcttgcgaaatatctttggttgaggcttctgcaagcatatttaaaatcaactcggtgttcgtcatattatcgcgtaagttttctttttttaatcctttgaattgcttatattctttggtagtttttccgctccacgctttagtgataatatcggttaaaacagcaaattgttgcccttctttcacaccgacccgtttccattcgtccgtcaattctttgcggatttcaatgctttttaaacgttggttaatccaattttccgaatagcctaatcgcaagtaatcctgcattgctcgattgatagtaagttctggatcttgcaattcatctaaacgttcacttcccacttgtgctaaccaaagtttaaatggctcagctttcggggacggaatggattgaattaagcgcagtagttgcggtacatcggctacgtcagttagtcgtaacttgccatcttccgctctcattttcaactggttacaatttgtaaccgtttcatttccttcttttaataaacggctttttagaactttccaatagttccttgcaccttgataattgggttgttccgtcaaaatttcgattacatcaataatcgaaaaataccatttttcttgttcttcgtcccaaacggaacgtacttctttgtgttcaaaaagtttgatgtccatattttcaaccattattaaattgctaacttagttttgcttatgctgattaaaccacccaacataatcaaactgatcgtaaaaacgtttcccattcaaaccgcaatactcaaacagatcgcctattttttgctgttgttcaaagccttgaatataaactgcggaggttagttctggatacggtttatgggtaaagacaactttattcttaaacggtagttgttcaaattcaagcagatcttcatagcgacagccatctcgctctgccatcataatgaaaagattattgagatccattcgagcggtgcgttcttgcctttttttaacagcttcttgctctgaatgatagtgcataaaataaatgtgaatatcgcctagtagcccaacggggtattttctttgaatttctttggggaaagtgatttcttgggtttggtagtgggcaatattttttacatatttaataaaatcagtgggggttaaaaataaatttacaaaaggggaattaaagcgtaaacctaaatcgtgcaacataaaagcccctgtgcagttactagcaattacagtcagggtgtttgtgtttaatcgttggcgatttttggcgttgtgttttttgcgaaaaaaatcgttgattttatttgttatttttctgattaaaggcatttatattccttgttagcggtaagattttcccattattttaccgcttgttttcagtattatgtatcaaagaaagaaacaaggggcatcacgcttggtgtccatcgaataaagcaggacaccaagcgtagcaaaaaattaactcattcgatagttcggcgcttctttcgtaatggttacatcgtgaacgtggctctctttgatacctgcaccactaatgcggacaaattgtgctttggtgcgaagttcatcaatggttgcacagccagttaagcccatacaagagcgtaaaccacccatttgttgatggataatttctttgagtaagcctttgtaaggaatgcgaccttcgataccctcaggaactaatttatctgcggcattatcggattggaaatagcggtcagatgaaccttttgacattgcccctaatgatcccattccacgataggctttgaatgctcgcccttggtaaagctcgatttcacctggagcttcttctgtgcctgcaaacattgaacccaccattacacaagatgcacctgcagcaattgccttagcaatatcgcctgaatagcggataccaccatctgcgatgacaggaatgccacgatcttttaaggcttccgccgcatcagcaattgctgtgatttgtggcacacctacgcctgtaacaatacgagttgtacaaattgaacctggaccgataccaattttaactgcgcttgctcccgcatcagcaagggcaatcgcaccttcagcagttgccacgttgcctgcgacaataggtaagttcgggtatttcgcacgggtttcacgcacacgttgtaacacaccctcagagtgaccgtgggaagagtcgataagcaagacatcaacaccagcctgaacaagagcatcaatacgttcttcattacctggaccagcaccgactgccgcaccgacacgcagacgacctaactcatctttacaggcgttcggtttttgttcagctttttgataatctttaacggtaatcatcccttttagtttgaagttatcatccaccattaacactttttcaactcggtgatcgtgcataagttctaaaatttcttcacgattagccccttctttgatcgtcactaaacgctctttaggtgtcatcactttagaaacgggcttatttaaatcacgcacaaaacgggtatcacgagcggtgataatacctacaaggttatcttctgcatctacgacaggatagcctgcaaaaccatttttcttcactaattcagctaactcgcctaatgttaaatcaggggaaacggtcactggttcagaaacgataccgctttcaaactttttcactttacgcacacgatctgcttggcgttcaattgacatatttttatggataaagccaattccgccctcttgagcaagggaaatcgctaacttagcttctgtcacggtatccattgctgcagaaagcattgggatatttaagcgaatgtctttggtaagttgagtagaaaggtttgcggtatttggaagcacggtagagtgtgctgggacaagaagaacatcatcaaaagtcagtgcttctttaattactcgtagcattgcaatagttccttaatttgaaagttaaaaaataaaactggaaaaattgcgagcggattatacagagatttagttgagttgtaaatttacaagtggttagatttgttaaattttttgccaaaaagatgggctattagcccatctatctttgttagacaatctcgtaatacaactcttgatactgctgtgccacttttgcccaaccgaaatcttgagcaagggcattttggcgtacactcgaccacaatttatttttaccccataaattgatcgcacgcagtacggcatcgtagaaattatctgcgtcaggatagttaaacacaaatcctgttgctgtgcggttttcaatgctttctttgtgtgcgtcattgacagtatcggctaaaccacctgttcggcgaactaatggtagagtaccgtattttaagccgtaaagttgggttaaaccacaaggttcaaagcgacttgggactaagataacatcaccacctgcgataatttggtgtgaaagagcttcatcataaccaatttttaagccgattttatgtgggtaacgagattgtgcatcacgcaatgcccattctaagtcaggcgatccactaccaagcactacaagttgaacgttgtgttgcatcatttggtcaatgcgtgcaagtaagaaatctgcccctttttgttcggttaagcgagtaaccatcacaaataagagtgcatctttatcttctggcaagccaaagtaacgttgtagttccgatttgtttttacctttaccttgcatatagttcgggcggtaatttgccacgatgtttgtgtcggtttcagggttccaaacagcatcatctacgccatttaaaatgccacgcaatgccccttctgcaaggcgttgttgcagtaagccgtgcattcctgcccctgcaatttgctcagtaatttcacgagcataggttgggcttacggttgttacacgatctgcgtagaataaacctgctttaagataggaaatttcgccgtaaaattctaaaccgtgaacattataaaattcccaaggcaaggctaattctgctaagtggtaggcttggaaacgtccagggtaggcgatattgtgaatggtgaagacacttttaacagggctgttccagcttttgagataagcacaagctaaacctgcttgccagtcgtgagcgtgtaacacatcacttctgccccaccaatgatctaaacctgaagcaagttgtgctccgagataacctaatagtgcaaaacgtttgtagttatcggtgtaatcttggtagttgtcgtcgtagtaaggtaaacgacgatcaaagagatgtggggcatcaatcacatatacgcctaagccattcaaataagcaaaacgaacagtgacaacacctgcaaaggtaccgacggtcgcaacttcaacggtttcgcctaacttggaagccacttgtggataataaggaattaatactcgaacatcatttccagctgattgttgtgcatagggtaacgctcccattacatcagcaagtccgcctgttttgataagcgggtacatttctgaacaaatatgtaaaattttcattaactatttaccaatttaaataaattcttcccccacttgtgggggaagtggttgagtgaaacgaaaccgatggggggcaaataatcccccatccccacctttggtgggacttcccccgtaaacgggggaagaattataaattaagcagccgctttatcttttgccaatttatctaacattttttggcaaactaagacgataccacctttactgatacggaaatatttcgcatcttcttctggatttacaccgatttgtaagccatctggaatatcacagtgacggtcgattactgcacgtttaattacacagtttttaccaatgttcacttgtggaaggatcactgattgttcaataatggaatcttcatggacatgaacacggctaaaaagtactgaattactgatctctgcatcggtaatcacacagccccctgcaatcaatgagttatcaagggtatgcgcacgcgcttttttatagaagaaacgagctggtgcagtttgttgtggacgaccgtggatcggccaagattcgtcatataaatctaattgaggtttttcgctgactaagtccatatgggcagaccagtagctatcaatcgttcctacatcgcgccagtagattgttccagtggtgttacgaccttcacaagaacgctcaaatgggtgagcataaatcactccttgttcaacggcttttggaataatgtctttaccaaagtcgtgtgaagtatctgggttgctgacttctttttctaacatttcatagagataatctgcgtcaaacacatagatccccatagacgcaagagatgagtctggtttgtctggcattgctggtggatctgacggtttttccacgaaggctttgacttttaatttttcattaaccgccatcacaccaaattccgttgcttgttcacgtggcacttcgatacaacctacggtacattttgcccctgaatcaacgtgatcttcaagcatacggttgtagttcattttatagatatggtcacccgcaagaataatcacatattttggacgatagtgcgatttcatcatttccatattttgataaaccgcatcagctgtaccacgataccaagtgttctcatcaatttgttgacgagctggaagcatatcaatgtattgattacgctcataaggtaagaatgaccaaccacgttgtaagtggcggagtagtgaatgcgccgcatactgtgtaatcaccccaactttcaataagttagagttaatacagttggaaagggcgaagtcaataatacgacggctaccaccaaaataaaccgcaggttttgcacgtttgtcggttaattcataaaggcgtgaaccacgaccgcctgctaagataagaactaaagtttgtgcagtaagattacgtctgtcagttgatgcttcctgttttagcatattgttatctccaaattgggatggtgaatattaattcctttgaagtacacatacctcaatgtgattgagagtaaccgcaagcgtatcggtcattagagtggtttctttttcacctaaaagtatttgccaatcacccttaggtaataaaaattgttgcattgcttgtttggcattgaccaaaataagccatttatcttctaatagtatttgtaaggctttggttgaatagtcttgccaatctttaaattgaataacattcgcatcagggcgtagccactgaactttttcaccagaccaccattgattatcacgagataacaaagggatctgcttacgaatagcaatcagctttgacgtataatcaatcaatgcttcgtcagcggtttgccagtcaatccagctaatctcgttatcttggcaatagctgttattgttaccttgttggctatgccctaattcatcaccagccaacaacatcggtgttccgctcgagagcaacatcgtcgccagcagagcttttttcgctaactgccgttgctcaataatcgttttatcgttggtatcgccttctaccccgaaattatggctgatattatttccgtgtccatctcgattttgttcaccatttgccaaattatgttttttgttatagctgactaaatcgtgcaaagtaaaaccatcgtgagccgtaataaagttcacactgtttgaaggtaaacgatggcgagcaaaaatatcatcactgcctgcaaatcggcgaacaaacagccctaaatcaccgcttgtttgcaaaaagaaacgacgcatatcatcacggaaacggtcgttccactcggcgaatggtttagggaatgcccctaattgataaccactccagccaatatcccacggctctgcaatcaacttaacgtgagataattttgaattactatatatcgctgtaaaaaaggcggatttttccgaaaacgtcggagaacgtcctaagacagcccctaaatcaaaacggaaaccatcaacgtgacactctttaacccaatagcagaggcaatcaatcacccaacgcaacaccgccacatcagacgacacattgagcgtattgccacagccagtccagtttagatagtcactattatcagtaagccaataatatgcttcattatcaatgccacgctgagatagcgttggaccatctttaccagcttccgccgtatgattaaagaccacgtccataatcacttcgatccctgctttatgaagcgttttgaccaactgcttaaattccgttagcggatcggctttgttataagctaatttaggatcaaccgcaaaatgccctaaaacgttataaccccaatagttgcataacccgattttttgcaaatgcggttcatcaatatgataggtaatcggcaacaattccactgccgttacccctaaacgtttcaaatgagcaattgacgtttcgtgggctaaccctgcaaaagtgcctgcaatttcgcttggcactttaggattaagtttactaaaccctttaacgtgcgtttcataaataatcgtttcagcccaaggggtaaaaggtttatagtcaccttcccaatcaaaagtatctcgtgcaaccacgacagattttggggctaggtgagcattatctctcggatcattccactgaaaccatttcaccgcttcatcactggataaatcaggttgtcctacaatgccatttgcataaggatctaccagtaatttattggggttaaacaggtcgcctttttcttcatttacacaccctgttacccgatagccatattgcgtccctgcttttagaccgaccacaaacaaatgccaaatttcatcggttttgatcatcggtaaacgaatttctttaccgtcgcaaaaaattgctaattccacaccgcttgcacggcgagaaaacaatgcaaaatttacgcctttttctccatttatttcagttaatcggctacctaatggaaatggtctgcctgcaaggtacttcatatacagccttagtacttattgtagggacacactgcgtgtgtccgacatcttaaacaattatattatttgaaatcttcgctccccctgtttacggggggagctgggcgaagccctgaggggggaacaataatatcccgccttcggcaccttcccccgtaaacgggggaagggaatttaatcaactttttgtaactactacataatatagaacatttgaattattagatttgtaattaatggacacacgcagtgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgctaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtatgcgtaaactgctaaccattatgaatgcgttggttagacgcaatgaaaaatgggatgctacacgctacttatccacagaatctgtgggtcaaaattgaataacttttttgtgtgtaaacacagttgctacattattttgcttttttggcttttactgctttggttttttccactttcggctcttccgctttttttaccacttttgcagattttttcgcttttttcaccgcttgtggtttgacttctttgacgataaaaatcgtcgcaagcggtgggatagtgagcgaaatggaataaggtttaccgtgcgactcaatctcgtcacattgaatagtaccgaaattccctaagttactacccatatagtaagcggagtctgagttgagaatttctttatattttgcatcttcgtgaacgccaaaacggtaattatcacgcgggatcggggtaaagttgctgaccacaataatgcttgaaccatcttttgctttacgttcaaaggcaaacacagactgctctgcatcatcaaccaccaaccactcaaagccagcaggatcgtaatccaactgatacagtgctggatattgacgataaatacggttcaaatcacgcacccagttcaacatacctttatgccaaccatcgtgttcatcgttaagcaagaaccaatccaagctctcttgataattccactcacgcccttgagcaaactcgttgcccataaagagcagttttttacctggataaccccacatataaccgtaatatgctcttaggtttgcaaactgttgccagcaatccccaggcattttaccgagtaacgaatatttaccgtgaacgacttcatcgtgggaaagcggtaacataaatttttcgctatactgataaatcataccaaaggtcatcaaatcgtgatgatatttacgataaatcggctcggtcttcatatagcgtaatgtatcgttcatccaccccatattccatttataatcaaagcctaagccgtgatgttccgttgggtgagtaatacccgcaaaagaagtggactcttccgcaatagtcacaccgcctttgccttctttcgctaacatatcattcgttgaacgtaagaaatctaacgcttccaaattctcacgaccgccatagcgatttgggatccactcgccatctttgcgagagtaatcacgataaatcattgaagcaaccgcatcgacacgcaatgcatcaataccgaaacgctcaatccaataaagcgcattacccgtcaaatagttacgcacttcgtgacgaccataattgaaaatcaaggtattccaatcttggtgataaccttcttttggatcggaatgttcatagagatgagtaccatcaaaatacgccagactatgttcatcggttgggaaatgtcctaccacccagtctaaaatcacattaatccctgcttcgtgagccttactgattaaggtgcgtaaaccttcaggtgaaccaaaacgactggttggggcataaattcctgttggttgataaccccaggagccatcaaatggaaactctgtgactggcaataactcaatatgggtaaagcccatttccttcacataaggaattagctcattcgcaatctcttcataatttagccaatagttattttctaaattacgtcgccaagagcctaaatgcacttcatagacagaaatcggctgatcaggatcgttcgcacgacgacgtttctcgtcactctcgacaatcgcaggtaaaccagaagcaacagaagccgtatcaggacggaattgagctgagaacgcataagggtctgatttcaaacggatttgtccatttctatctaaaatttcaaatttatagagcgttccttttggcaagtttggcacaaaaatatcccaaataccgctgtttgaatgaaaacgcattgaatggcgacgaccgtcccaatagttaaaatcacccaccacagatacacggcgagcattcggcgcccaaaggctaaagtgaataccgccaacttcattttgggtaacaagatgagcacctaatttttcataagggcgaacgtgggttccttcagaaagcaaccaattatctaaatcggaaaaatgggactggaaacggtaaggatcttcaatatcaatttcagtgtgggcataacgcactaacaagcggtaggaaaggtcagttttttcaccaaccaaattcgcagcaaagaagccacgatcatcaatttgctccatctgcacaatcggctcactgttatcattaataactgttacctgttctgcttcaggtagataagcccgaacaatcacgccatcatcaacttgatgaacccctaaataagcaaaaggatcttggcaacacccgttcgcaagctgttctatgaattgattatcttgcttgagtgaggtggtatttttaactttttctttcatttgctctccttggctaatttatatacgctgggaatgatgaaataaacgtttgcgtagcattctattaaaaatagctttacaaaacaatcacaatttttgatatagatcataatctcatagagaaaagctccaatagttaaaaatcaataagttaaataaaaaatgatagatataaaaaatttttcaaatgtataaaaaattttcatttgaaatatggaacttaactttgtaaataaaagtaaataaagatgaattactttatactaactcagcagtgcggcactgcctaaaagatagggaacgacttccgtcgcatcagataaatgcacaaataagtggctggtttccacctttgcataagcacaaacgccctgcgttaagctgagcgtaaatacaacaaaaaagcggttaaagttgttcaaacaatgatttacccaagtaatcattttcatctttaactcctgcaaagcacgcaaataatccgctaccgatatgggtaatgtattcgttcatcttgtcgatattgccaaggctgttttgaatggtaataaattgttgcggctctttttggaacgagataaacaacaagcctgcatcaaactgccctgttttcggctcaacaccgctggcataagagaaggaacgtcttaacatctgtaaccctgtctttttcgccaataacacattcacatcttggaagcgatcagcaatctcttttgccaatttcgcatctttttgctctaattttggcttaaagatcgcataaatttttttccgccccttcaatgttggctttgaaatcataaaggtcagtttttgaaaaaatctcttcttcgcccgttacttttgtggtggatacttcatttaacaaatccaccgcactggtaatcattaaatcaggggtgacttccgccgttggaattttcgcacgcagttctttcacatctttgatcaactgatcagcggtcgcttctgtgccttttgtggtattttgctcccaaagcactttctcaattttatggaaacccgaccaatctttctcggtttgcccttcttcacttaaatccgcaagacgagcatcaatacgagggtctaaatcgccaaaactctctgcaatcggctctgaacgctcaaagtacatacgtgcaagcggatagatttgcttcgctttttccacatcgcctgccttcaaataccccacaaatttctcggtatctgtcactaattgatcgatttgcccaactacaaattccttataagtttgtgtttctttagataaatccgttgcaaaaacggaagtggcaacaaataaacttgaaatcgcaagggtgagagattttaaacgcatagaaagctccttgattttatcttatgaagaaaaataaataaaacttattatcaataagaataaagttttcatttacgtttacaattgaatttactacaaaattaataaaattttaatttagcttaatttttaagctacaaaacagtcaaaataaaaacagattctttaaaaagaaaaaagccgatcaactatttagatgatcggcatacaataattacatttaatttgacgttaccgtttcttcgcaaactctttttcaagttcaggtaacacttcttcacgataccaacgtgggtggtgttttttcgcccagcgaaccgttacccaaccttctaccatacctcgaattgaacctttcacccagaatgccatatacatatgcaccatgatgccagtgaacaacataaaggcacaagctgagtggaataagatcgcaatacgaattactggaattgagaaattatgtgcgaaatattgacgccacataataatccctgtaatcagcaaggtgaacattgcaaggatcaaagtccagaacaacattttttgaccaaggttatatttgccgttgtcggaaactgcgtgttcgttaccttttaatacttctacaatgttaactaaccatacccagtcatttttctctggaatattatgatgccagtaaatacgaaccatatttacgaaagcaaggaacataataatccctgtgaatgggtggatcattcgtgctaattgtggtgtacctaaaatatccactaaccacgcaaaatcagggaagaagaatgctaaccctgataagcctgtggtaaagaagcagatcacgagtaaccagtggctccaacgagcaggcaatttatggcgaacgattcggtaatcgttagggatttgaatcttactcatctttgcctcctttatgttcttcaccctgttcatcgtagtgttcttcgtgttcgtcaagatcttctgtatttggaccgattgcgatatagtgtgcaatttcagaaagaactaagccgcccattgccactgcagcaactggtttgagtacgtctttccaaagggtgacacttaaatcaatctgcggatctttcggtaaacctgagtatagctctggcttgtctgcgtgatgtaacacatacataacgtgtgtaccgcccacgccttctgggtcgtataagcctgcattttcgtagccacgagatttgagatcggcaatgcgtttagacgcatattctttcatctcttctttgctaccaaagcggattgcacccgtcgggcaggttttcacacaagctggctcttgtcccacagtgacacgatccacacagagtgtacatttgtacacacggtgatcttcagggttcattcgtggaatattaaacggacagcctgcgatacagtaaccacagccgatacatttgtctgattggaaatctacaataccgtttgcgtattgaatgattgcacctggtgatgggcaagccttcaaacagcctggctcagaacagtgcatacagccatctttacggatcagccattccaaacggtcgttttcttccacttcgttaaatcgcattaccgtccaagcctgcggattgagatccgcagggttgtcatagaccccggtacaagctgcgtccagggttgaacgaatgtcgttccactctgaacagcccacttggcaggctttacagccgatacaagtggtgacatcaatcaatttcgccacttccacttgatggctacgcgcctgtggcggtggtgtcaagaatgaaattgcagaggatttaataatatcttgagattgaactgtactcatattatgcccccacaatattctcaatattgactaacatacatttcgattcaggcgtttgtgtattcgcatcacctgcacgaaccgttaagttattggcaaagaagccttttttagcacctgttgttgccgcaaagccccagtggatcggcacaccgatagtgtgaattggttttccatctgacactaatgcacggatacgtttagtcaccactgctaccgctttaatgtagccacgtttagagctgactttcaccatatcgccgttattaatgcctttctctttcgccaacgcctctccgatttccacgaattgttccggttgagcaatcacgtttaagagggcatttttcgtccagtagtggaaatgctccgttaaacgataagtggtcgcaacataagggaactctgctgaagtaccgagttcttctttatccgttggtaaaatacgggcaactgggcttgaaaccacattagggtgtaatgggtttgtgccgattggcgtttccattggctcatagtgttctgggaacggaccatcaaccatacgctcacgcacgaataaacaacttaccccttcaggttgcataatgtatggcaatgtcgggctatctggcggtgcagcaccaaagtcggcaacatccacatagttccagtttttgccattccatttaacaagctgacgtttcgggttccacggtttacctgataaatccgcagaggcacggttataaataatacggcggttcattggccacgcaaagccccaacctagggtattacctaagttagatgggtctgagttatcgcggtttgccatttggttgcctttttctgtccattgacccgtgtagatccagcacgcacctgaagtcgtaccgtcatcacgcatttgtgcaaagcttgaaagtagctgaccttttttcaaaataacattgccatttgcatctaaaagatcttctaaggcatagccgttattctcttttgccacttcttctgcttttggttcaagtggatttgcatagttccagctcattgcctccaacggttcaagcggtgcttttccgccttctttatgataaaggtgaattaattccgcacgcaattcagagaggatttcgccgtctgttttcgcctcacctggtggttctgcccctttccagtgccattgtaaccaacgtccagagttagcaattgagccatcttcttcaacgaaacaagtggttggcaagcggaatacttctgtttgaatttcttcggttttcacgtcgttaaattcgccgtaatttttccagaattcagaagtatcggtaataagcgggtcgaaaataactaaatatttcaaattgcttaatgctttaacaattttttgagaatttggataagaagcaattgggttcattccttgacagaagaaacctgttaccttgccttgatacatttcttcaatgtaacgcatatgatccattccgtcttttggtaatttaggcaagtaatggtagccaaattcattatctttcgtcgctttatcaccatagaaggatttcagcatactcaccataaatttcggtgtatttgcccaatagttcacctgatctttcatcatctgtttcggcgtaatacgtcctaagaatttctctaaagaagtatccgcttccgttggtaatggaagataagctggtaaacgatttgggaataaacctaagtcggtgataccttgtacgtttgagtgcccacgcaatgcgttcacaccgccacctgcaaccccaatgttacctaataacaactggataattgccattgtacggatattttgtgaacccacagtatgctgtgtccaacctaacgcataaaggaacgttgccgctttttctggtgcagcagttttcgcaatttcttcacagaaaatgtggaaatctttttgtggtgtacccgtaatacgttcaaccatttcaggcgtataacgtgaaacgtgtccttttagcatattgatcacacaacgtggatcttgcattgtcatatcacgttttggttgcccttcttcatcaaattgataaccccaagttgaacggtcgtatttacgcgtttcagggtcataacctgagaataaaccgtcttcaaacttaaagttttcattcactaagaatgtcgcattggtatagtgtttaacgtattcgtgttggatcttatcgttttctaagagataacgaataacacccgataagaatgcaatgtcagtacctggacgaagtggcatataaatgtcagccacagcagcagtacggttaaagcgtggatcaaccaccattaacttcgcaccgttctgttttttcgcctcaatcgcccaacggaagccaacagggtgggcttctgcggcgttaccgcccattacaataacgagatcagcgtttttaatgtcaacccagtggttagtcatcgcaccgcgaccaaatgatggagcaagacttgctaccgttggtccgtgtcagatactcgcttggttgtcagtaaaaacgataccgagagaacgtacaaatttttgagtaagaatacccgtttcattactacacgcagagcctgctaagaaacctgctgtcatccaacggtttaccgtttcacccgcttcatttttctcaataaagttagcatcacggtcatctttcatatggcgagcaatacgctcaattgcttcgtgccaagaaatacgtttccactcttttgagcctgcttcacgcacttctggataacgtacacggcgatcactatttacataatctaacgcaccagcacctttcggacataacgccccacggctcactgggtggtctgggtccccttcaatatgaataagtttcccacgactattcattgctccatcgccaagactgtatagcaacataccacagcctacagcacaataagtacaggtgttacgagtttcttttgctcgtaatagtttgtattcacgaggtgcggctaatgctgttgctggggcaaatcccaacatagcagcagacgtacctgccataccacctgcacagatcttgaagaattttcttctactgacctgcataaatcactccaaaccgcatttgcggtgtttattaataaataataaaattttgtctattaactaggattaaatactaaatgaattttagaaggcgataagcaaataaaaaatcctgataatgccttattttgcaatcattatgtatcagatatttttctgttaaatacgcccccttataataataaacatcatcggaaatttttactatagaatagttatttttattttcctaaaaaataactcttgctttttcttttgttcttgcctttgctttttagcctgaaaaaatgccaaaataagaaatattacaaatgataggcaaaaaacaaagactaaaaatttaataaataacataatttaataccttataaaatagttttaacaacctaacaaaataattaatgatattatcctactaaaccaacttaaaaagcagcactattacggattaattaccatctatttgatataagccaaaattctgcaaatgatacaattttttaacaaaataaactacttaataaacaaattttttcgaggaataatgtgaagaagatcactaaatttgatgtagatcgactttttgttgagaatggttctctacaacagcaatttcaacaagataatatcatcagagaagtgcctgtggctctcgtttataatggaatttcacatacagttatgatgtgtacccccgacaatttagccgattttgccttaggtttttcccttgccgaagggattttaaaacagaaaagcgacctctacggcttagacattgttgaaagttgtaacggcatcgaaatccaaatggaaatttccactcgtcaattcactcaattgaaagagaaacgtcgttcaatggcaggcagaacaggctgtggcatctgtggggttgaacaacttgaacaagtcaaacagagttaccaaacttttccacaatcgcaccgcttgtcaaatatatcccctttaatcttagatgattgtttagctcaattagaacaggctcaaactcttgctaaagaaactggggcaagccacgctgctgctttttttagccctgacggcacactcttagctatccgagaagatgttgggcgacacgttgccttagataaactgttaggctggtatgcaaaagaaaatgccccacttggctttgtgtttgtcacaagccgagccagttttgaaatggtacaaaaatgtttagcttgtggcattgaaatgctttgtgcgatttcggctaccactgaaatggcagtcaatatcgcaagggaaaacgactttacactactcgcttttactcgaaaaggaaaggcaacagtctattcggggggtaatcgtttgtattttattaaataacccataataacatccgcatacaaaacatgcggatgttattttatctcaaagagaaattaagcattaccgccagtgattttcgctacttctgctgcgaaatcttcttcaactttctcaatgccttcacctacttctaaacgaacgaagttagttactgaagcatttactgattttaagtaagcacctacagtttgtgacggatccataacgaatggctgacctgttaatgaaacttcgccagtgaatttcgccatacgaccttcaaccattttctctgcgatttcttttggtttaccagagttcattgcgatttcaatttggatttcacgctctttagcaacgacttccgcagaaacatcttctgggtttacgaaatcaggtttagacgcagcaacgtgcattgcaactttcttaagttcttcttcagcaccttgaccagctactaatacaccgattttcgcaccgtgtaagtattgtgcaatcacttgaccttctaagtattgaacacgacggatgttcatgttctcaccaattttagccactaatgcagcacgtttttcttcgaattgtgcttgtaatgcttcgattgatgtatctttgtttgcaagtgcataatctgccacttcgtttgctaaaccaacgaaacctgcatcttttgctacgaagtcagtttcgcagttcatttcaactaacacaccgaaacctgcaccgatacgagcaaggataacaccttcagctgctacacgacctgcttttttcgctgctttcgcttgacctgatttacgcatattgtcgatagctaattcgatatcaccgtttgcttctactaacgcttttttacattccatcataccagcgccagtacgctcacgaagttcttttactaatgctgctgtaatttcagccattttttattcctctcttaatagataaaaaagcaggggtatgttgcccctgcttcacaatgttgaatgtgttttaagggcttgccttaaagacgattactcagccgcttcttctgcaacaaattcagcagcaacggtttcttgaccacgaccttctttgattgctgctactgctgcatctaagtaaagttggatcgcacgcgctgcatcatcgttacctgggataacgtagtttacgccagctgggcttgcgttagtatcaacgatagcaaatacaggaatacctaagttatttgcttctttgattgcgatatgctcgtagtctgcaccgataacgaaaattgcatcaggaagaccagacatatctttgataccgcctaagcttaattcaagtttagccatatcacgagtacggtctaatgcttctttcttcgttaatttgtcgaaagtgccgtcttgtgattgcgcttctaaatcttttaagcgtttgattgattgacgaactgttttccagttagtcaacataccacctaaccaacggtggtttacatagaattgttggctttctactgctgctgctttaactgcgtcagatgctgcacgttttgtaccaacgaaaagaattttaccgttgttgcttgcaatgcgagttaattctgctaatgcatcgttgaataatggtaatgttttctctaagttgatgatatgaacaccgttacgagcaccgaagatgaaaggtttcatttgtgggttccagtaacgagtttggtgaccgaagtgaacgcctgcgttaagcatatcgcgcatagatacttgtgccataagaatagtttccttgttgttgtttctgccgcggcagaaagggttttgcctccacatatcctaagtcatcgaccgtttctcttaatagaaaaacagcaccccgatgtttagtttgtgatatgtgtgtgatttagtgaataaaaaataaaatgttttttgcctacattaatctgcaaggacaaaaaacgagcggattttacttgaatctgaagtaaaaaaccagtacttttcaataaaacatgtacaagattttgaaaatttatatatattaagaaattattccaatagaataacaactagtttcgtaacattatgctattgttcctcacgtttaaacaccaattcggtgtctgttgaagccgtttcatcaaaccaatagccaccataattaaaggctttaagctgttcaacgctggttggttgggtctgcaacataaaccgcaccatcattccacgggcttttttcgcataaaagctaatcactttgtatttgccattcttttcgtctaagaaaacgggtttgacaatttttgcggttaatctctccgcttgcaccaccccgaagtattcatcggacgcaagattgactaagatgttatcttcttgtgcatcaatagcttgctggagatgttgggtaatgatgttatcccaaaagtgatataaatctttgccttttgggttagccaatttcgttcccatttctaaacggtacggctgcattaaatctaaaggttttaataagccatatagccccgataacatacgcaaatggcgttgagcatagtcgatttcagcattggttagtgtttctgcttctaagcccgtataaacatcacctttaaaagcaaataatgccgctttggcgttttgctcattgtgttccattgtccattcggcaaaacgagcaacatttaggcttgccagtttgtcgctaattgacatcaatgatgccacttccgcaggggaaaattgtttgcaaatatcaattaattgctggctgtaagcggttagttcaggctgagaaaatacaaatccgtcaattttagtttcaaaatcaagggttttagctggggaaataatggcaagcattttgacctcaaatatgtggcaggtaacacagttgggacacactgcgtgtgtcccaacggattattataaaagtagggacgccacgcttggcgtctatttatataagtcacacttcgtctttgtaatggacgccaagcgtggcgtccctacaatcactttgaatatttttattacggacacacgcagtgtgtccccacttgtttaaacctatttctgacgcattgctgggaataggatcacatcacggattgacggtgcgttagcgaaaatcatcgctaagcggtcgatacctaagccttcgcctgctgttggtggtaaaccgtgttcaagggcgacaacgaaatcgtcatcgtagaacatcgcttcatcatcacccgcttcttttgctgcaacttgtgcttggaaacgttccgcttgatcttcagcatcatttaattctgagaagccgttaccgatttcacgtccgccgataaataattcaaaacggtctgtcacttctggattttcatcattacggcgtgcaagcggtgaaatttccgctgggtgagccattaagaaggtcggctgaattaattgatgctctgctacttcttcaaaaatcgcattgacgatagaacctaaaccccacgatttttggatttcgatatttaagccttttgcaattgccactgctttgtcgaaatcgtgtaggtcgtccattgaaataccgttgccatatttcacaatcgcttcgtgcattgtgatacgttcaaacggtttaccgaaatcaaacacatattcgccgtaaggcacggtcgttgtacctaaaatatctaaggctaatttgcgtaataattcttcggtgttatccattaaatcgtggtaatctgcataggcttggtagtattcaatcatcgtaaattcaggattgtgacgaacagacaccccttcgttacggaagttacggtttaactcgaatacacgctcaaaaccgccaaccacaaggcgttttaagtaaagctctggagcgatacgcagatacatatccacatctaatgcgttatggtgagtaataaagggttttgccgctgcaccacctggaatcacctgcaacatcggcgtttccacttcgataaaatctttctctaagaagaattgacggatacctgataccacttttgagcggataacaaaagcacggcgagattcttcgttcgcaataagatctaaataacgctgacgatagcgagtttcttggtctgttaaccctttatgtttgtttggtaacggacgaagcgctttggtgagcagttgtaattcggctacacgaacagttaattcacctgttttggttttaaatagcgtgccttttacaccgataatatcgcctaaatctaataagcccacggtgttttcatattcaccttcaggcaaattatcgcgagccacataaagctggatctgaccgctgacatcttgaatagtaacaaatgtcgctttacccatcacacgacgtaacataatacgccctgcaactaccgtaggaatttctttagctttaagtgcttcgccatcaacttcatcatattttgcgtgaagatcttccgctttatcttcacgacggaatgtgttcgggaacggattaccacgctcacgcaactgagctaatttttcacggcgagcgatcatttcgccattgagatctaattcttggttttcgacttctgacattgtattaccttaagatttttaaaaataaattcggtttaattcatttaagtttgaaagggcgagattataagcgattttggaagattttggtagaaaacaagcggtaagattcgctaagtttttacaaaaaaatcaaggttggaaaaccaaccttgacttagaacattttagattaattgtgctttttgtaatgctgcagtaattaccggatgatactgtttagataatactgtaagcggtaaacgtaagcacggatcactaattaatcccattttatgagctgcccatttcactggaatcgggttgccctcaacaaacagatttgtatgtaaatccattaagcgttggttgatctcttctgcttcatcaaatttaccttcaagagcaagttcgcacatttttgccatatctgctgcagctaggttattagttacagaaatcacaccttgcccacctaatttcattgattctaaaccagtcgcatcatcgccacttaagaagataaaatcttcgccagcaagtgctttgatttgtgcaacacggcttagatcaccagttgcctctttcactgcaacgatatttggaattttagctaagcgtgcaattgtttcaggttttaaatctgttcctgtacgacctggcacgttatataaaatctgaggtaacgatgtgcattctgcaatcgctttgtaatgttgatataaaccttcttgggttggtttattgtagtaaggtacaacactcaaacagccagcaacaccactgtctgcaagcaattttgtcattgtaattgcttcacttgttgcgtttgaacctgtacctgcaataacgggaacgcgtcctgctgcaaattcaacggttttcttaatcactttcacattttcatcaatacttaatgtgctacattcacccgttgtcccaacagaaacgatagcgtgtgtacccgctttaatatgaaactcaactaactcttttaatccatcaaagtcaatttctccgtgtttcattggggtaatcaaagccacaatactgcctgaaaaaagaggttttgacataattttctcctgtatatcttttttgttaaataatacgatagcttgcaaaattcggcttcaatatgcaaatgttttccaccaaaattgcaaattttttctaaaatcctaccgctattcaatgcccttttgataagacatcattacaagtgttcgccatttttcattaccatcgctgtctttccccatattcgcaatatttggaaaacgcccccaacactcaaagccgtgttttttcattaaattcatacttacttgatttaattcaaaaacatacgccatcaaagtatgaatcctatgctctagcatcttatcttgcatatactggataattttcgagccatagcctttaccttttgctttttcatcaaggtaaaggctgatttctgaagtatgcacaaatgctgggcgttcataatatggggaaaagctaaaccagccgattacaccattttcatcttccactgtccataagggatatttctcactagatagatgaaattcaaaccacgctttgcgtgtttctcttgttgcaaaataaagatctgcagtcatttggtgagtcggaatcgcttgattataaatggctaaaatagcatcaaaatccgtttcaactgatttgcgaatatgcattcatagatccttttaatttagctgtaataattcatttagcgcttgagcaatactgtcttcgttatttgagccgatcacttttttcgcactttgctggacttccagctctgattcgcccattgcaatccccataccaaccagttttaacatactaatgtcgttaaaattatcaccaaaggcaatcacattctctgtgtcaatttgttcacattttaataattctgccaaacaagcccctttgctatttcctgctttagtaatatcgacacgatctacccaagaccattcagcactcacctcaagcggtaatgtttcgacaaatttttgcattttctctaggttaggatcgctaattaacactttccaaatggttgtgccattatcaataaaggtttggaaattttcggcttgatacacattagggcgaacattttcaggacaacttacaacccattttaagaatttggtgaaatgtgcatttaacacttcgtaggtcatcgcatcacgagtataaacagcaacatgaatcccttctgcttttgctgaatgaattaacttttctgccaatgcattacctaacgggttagccgataacactttatcattctgaaaatcatacaaataagtcccgttacaacagacaacaggggtatctaacccaagttctgcataataaggaagtaccgccgtatgatgacgacccgttacaatataaacctttagtcctttctcttgtgcttgcttaattgcttttttacttgattctaaaatggtgccttgacttgacagcagtgtgccgtcaaggtcgaatgcaatcgcttgataagacattacttcgctccttataaaacaaaaaaagggtcactcccttacgaattgacccttttattttactacgtcataaacatcaaagcagcaaattatttagctggattatatgaaggagtttgataaagcggagctgggccttgaggacctgcaacattaccactttcgttctgttttaatacaccaccattagctgtaatttccacacgacggtttggacgtaaacagtcacgtaatgcttgacctgattcaccatcacaagctttaacttggtttgctttaccataaccaacagcctcaatcggcactttaataccttgctctactaaacgagctttaaccatattagcacgacgttgtgacaaatctaagttatattcctcagaacctaggcgatcagcgtaacccacaagtttaaccttctctgcacctgaagattttaattgttctgcaacatcatcaacaacctctctgccctttgtagttaatatatctttatcaaaatcaaagaggaaatcaccaactaaattaaatgaagaattaccattacaaccatttggataccaaaagaaactttgcgcattcatatttttatcaaacaaaattttgaattgacaaattttgtgcacgcccttttctctatagttaaaagcatagtcccactcatgtacttcataaagtccttcagaaaaatgagggggaccaatcaaattataaagctgatctttgttcatccctttttcaatttgacgaacattttcccaattcggccatgatccaaattgagagccatcatgattaaattttgattccggaatttttggaaataccggtttttctgttgtaccctcatcggacaccttactcaaactaccacaagcagtaattgtaatcgctatagccgataatactccacgaaaaaaaattgtttttttcattctttatcccttaaatgtcaaattaactatctcttagtatagaatattatcagaaatatctatacttctttctataataaaaacctagcatgattctactacacaaaatcgtcttattctatctttttttatttgaattgatcatcttctaataaatattcaataagtagttggaggttttttcctcccctaaattcattaatatccaatttataaacaaatgttgcctgtttaatagataaatcaggatagcattttacatcaacattaaaccagatagcatcaaatagcgtaccatattcattttccaccatcattttcagatgttttccagccaaaagtttctgttgcaagatacgaaacctcccctcaaaagtcggttctggaaaatgttgcccccaaggccccgcttgtttgagcagttctgccgttgctagattaaattcatcggctaacaactcgccgtctgtataaatcacaccttgtaaccattcaggttctgcaacttcgttcacggtttcgtcaaatacagtttgaaattgagctaaatgatcttgatgaatggtcaaaccggccgccattgcgtgtccgccaaacttgacaatcaaattatcatatttagcatcgatacgttctaataaatctcgcatatgcagcccagcaatagaacgagcagatccttttaaatattcactatcatcactttcctgagcaaatgcaataacaggacggtgaaactgatctttaatgcgagaagccaagatgccaatcaccccttgatgccaatcaggttgatataacacgataccttgtgcttgattttgctgagagagcgttggcaacttagcacaaaggactaaggcttccgctttcatctcttgctcaaattctttacgagtctgatttaatgaatccagctctagggcaaattgacgagccaacgcgagattatcggaaatcaacagctctacccccaaagacatattctctaatcgcccagccgcattcaatcttggggcaatggcaaaccctagatcgctggcttgcaaagcatagagatctcgtttagccacctctgccaatgcttggatccccactcggcaatgccctgaacgaatacgatttaaaccctgattaaccaaaatgcgattattgtgatcaagcggaacgacatctgcaactgttcctaaagcaacaagatctaataattctgcaatgttaggctctttctctttgaagtagcacagctcacgcattttagctcgcagggccatcatcacatagaaaatcaccccgacaccagccaaagactttgagggaaaagtacaagcggccagatttgggtttaccattgcatctgcatttggcaggctgtctgcaggtaaatggtgatcggttacaagaacccgaatcccttgagctttaagtaaagcaatcccttcaaaagaagaaatgccattatctaccgttaaaacaaaatctgccccttttgccatgaccatttccgcaacactaaggcttaagccatagccttgtgaaaagcgatcagggattaaataatcaacctgctgaaaaccgaactgccgtagcgccaaaatcgccaaagcggtactggttgcaccatctgcgtcaaaatcccccacaatcacaatccgatcttgtcgagttaaactgtctaacagtaaatccacggcttgttccatattggcaagccctttagggtgatgtaaacctttgagagataaatccaactctgcagggctttttacccctcgactttgatagatacggtttaatagaggattttctgataatcgttgttctgttaattggggacgacgttggactaatttctgcataaaaccaaacttagttgtaataatatttatccatgctttaaagtagatatcattccgtttgcttacgatctagataatgataagactgaattttacgaatagtacgagaacgtcctcgaataagtaaggtctctgtcactgctaaatttccttgacgtagaatacccttaagcaaatctcctgaagtaatcccagtcgcagaaaaaactaaattatcatctctaactagatcttcaagcttcaatatttcattaatcggtacattcaatgcttcgcaacgatttatctctttttccgcataagcaaaattctctaaggaattacctttaacttggttccgtggaattaatctcgcttgcatatcaccgcctaaagcacgaactgctgccgcagccacgacaccctctggagcaccaccaatgccatataacatatctaaatctgcttcaggtaaacagcactgaactgctgcagccacatcaccatcaggaatcgccatcacacgaatacctaatttttgcatttcagcaataacgtctttatggcgtggtttatctagcaccgcaacggttagttgagaaagtaattttccttttttagaggcaacacgacgtagattttgctcaataggaaggcttaaatcgatcatacctttagcttcactgccaactaccaatttttccatatacatatcaggggcttgtaagaaagtttcttttccccccgcagctaataccgataatgcattcgcttgccccatcgctgtcatacgagtaccatcaatcggatcaaccgcaatgctgacttcttcatcttcaggacggcataaaccgattttttcaccgatataaagcattggagcctgatcaatttccccctcgccaataaccacttcaccacgaatttccatttgattcaacaaaaaacgcatggcttttactgcagcatcgtcggcagcattcttattaccacgaccaagccaagcaaatgcagccagtgccgccgcttctgttacacgggaaaattcgatagaaagggatcttttcattttaggttccttaaatagagatgtgtttgcaaaatttttgaggaatcctaccgcttgtagtaggtcataagcggaagcaaattgtaagggttagtagttttttagtcaatttttatcacaaattgggctaactattttgagttcgccttaatcgcgtgtagaatgtttcgttatttttactagtaagagagcgattatgagcaacgaagagattttacacgacgaacaccacgatgttcgtgccaactttattacccatatcattgatgaagatttagcctcaggaaaacataacaacgtctatactcgtttcccaccggaaccaaatggttatttgcatatcggccacgcaaaatctatctgcttaaacttcgggattgcagaagattataaaggtttatgtaacttacgttttgacgatacgaaccctgttaaagaaaacgtggaatacgttgattcaatcaaagaagatgtgaaatggttaggctttgaatgggaaggcgagccacgttatgcgtctgattatttcgatcaactttacggctatgcgattgaattaattaacaaaggtttagcctatgttgatgagctgtcgcctgatgaaatgcgtgaatatcgtggtacattaactgaaccaggtaaaaacagcccatatcgtgatcgtccgattgaagaaaacttagcgttattcgaaaaaatgaaaaatggcgaaatcgaagaaggaaaaatgagcttgcgtgcgaaaattgatatggcttcaccatttatcgtaatgcgtgaccctgtattgtatcgtatcaaatttgcgagccaccaccaaacaggcgataaatggtgcatttacccgatgtacgattttacccactgtatttcggacgcgattgagcgtattactcactcaatttgtacattggagttccaagataaccgccgtttgtatgactgggtattagaaaacatttcgattgaacgtccattaccgcatcagtatgaattttcacgtttaaatttagaaggcacattaacctctaaacgtaagctgttgaaattggtaaatgacggtattgttgatggttggaacgaccctcgtatgccgacaatttcgggcttacgtcgtcgtggctatacccctgggtctatccgtgaattctgccgccgtattggtgtaacaaaacaagataacgtggtggaatacagtgcattagagtcttgtattcgtaatgacttaaataccaacgcaccgcgtgcaatggctgtgattaacccagttaaagttgtgattgaaaactttgaaggcgaagaatggctaaccgcaccaaatcacccaaatcgtgaagaacttggcagccgagaattgctgtttacccgtgaactttacattgatgaagcagacttccgtgaagaggcaaacaaacagtacaaacgtcttgtattaggcaaagaagtgcgtttgcgtaatgcttatgtgattaaagcggaacatgtagaaaaagatgcaagcggtaagatcactacaatttattgcacctacgatcctgaaaccttaggtaaaaaccctgcagacggacgaaaagtgaaaggcgtaattcactgggtatctgcattacataataaacctgcggaattccgtatttacgaccgcttgttcaccgttgcaaatccaggtgcggaagaagatatttgttctgtggtaaatccaacatcgttagtggttaaacaaggttttgttgagccaagtttagcgaatgcaaaagcagaacaaggttatcaatttgaacgtgaaggctattactgtttagacagtaaagacggtagtgcagataatctcgtctttaacttaacggtaagtttaaaagagagcgtagcgttttaaggctataaataagataagcaaataagcgggcggatagcccacttattttgtaaattttcttgatcaaagtaaacattgactatagattttctcaaattatcacaaggagatataaatgagaaagctcacatatctaacttcacttgctatttttacaagtgctttacttggttgcagttgtagttgtgaaaaaacgcaaaaaccacaggaagagaaaaaagatgatcaggcgttgtttgaggaaacgctaaaccctacgccccctttaccaacaagtctgttaaaactgcctggcccaccaacgctcaatctgttagcaaccagtccatcaaatactgccgaatttaacgactttatcagcattatgggacaaaatggggcggtgattacgatgtggtctgttgatcgtcgtagctggctttggatgtatccgccacttaattctcaagattttggcaaattgcgtaattggcgaattgagcggagcttccgtcaagaacatttccgctttactaatcagcagatgggatcttgtatgcaggcttatggaaatggtgtgattcaagatagctgtgatccaaataatttagatcaagattttgagttactgccaacctcgacaggagcggtgttcattaaaagtgtttctcaacaacgttgcttaacttacaatgcggtgagtaccactggctattttacgctgactttggatcgttgtgatgataaacgtattacaccgttacacgatcaaacgttctatctcacaccaccattacttagtgctaatccattataggaggaaaaatgacgttatttaatcgagctatagcattagtatgttgtttacttcctcaaattgccttggcaaatttggaaaactatacggttgcaacgtggaacttgcaaggttcttctgcgattaatgaaagtaaatggaatatcaatgttcgtcagcttttgacggggcctcaagcggcaggtattttaatggttcaagaagcaggctctttgccatctaccgccgttcatacacgccgaatggttcagcccgagggggttggctttccgattgatgaatatgtgtggaacttagggacaagaagtcgtccaaataatgtttatatctattactctcgtcttgatgtgggggcaaatcgagttaatcttgcgattattgctcgtcgtatggcaagcgaagtgttcgtgattaattccagttccagtgtattaacttctcgtccagccataggtattcgtattgatgacgatgctttctttagtattcatgctctttcatctggaggagcagattcactaagtttgattcaaaatattcatacgttctttaatactgaggaaagacgacatattaattggatggcggtaggggatttcaatcgcgctcctggtcgtatgcaagaggctctagattctgaacctggactgcgtaatgctacactgattgttgcaccaacggaacctacccatcgttctggcaatgtattggattatgcagtgttacacaatgcgaatcaaaccacacaaaatacaacggtcagtgccagcattatgtttaatcagatgagatcgcagattacctccgatcatttcccagtcagctttgtgaaaaaacgttaagggggaagttatgctaaagcgttttactttattgatgacattaggactatgccagttttcccttgcagaaacaccaccgatgccacctgcacctacgccaacaccatcaacttatcctgatgttgttgaaataaagccccctattatctctttacgcagcttaaatacgggtgagcctgtatctaatcgtagctatgatcggaatgatccaagagaggtgcagtggcgacttgttgatgttattgttaaaaatcgtcggttcgttcaatttcaagtatttggtaaagaaaatcgatgtttagttggagatggtggtactttaccctgtggacaaacagacactttatttaggttagtcccaaccgatacgggggcatttattctgacagaccccaatacgggaaaatgtttaaccagcgagaattatggcagttatggttttcaaaactgcttgcgaacttcttcagcagaacctagcaatattccgctaaaacatctttggatcattgctccgccttttgggcctagtaggttattataacattacaatttttaggggctaaattgattagccccaattccaaatcagtgccttcctcaatgccataaaaaaatctatcgttttcctctgccaaccagatactgacacgcaaggtttgtatgccataacctgcatccaaacatcccatttcctatctttttcacttcattgcaaacacaattttatttataggaaatttttatgtctcatctttctgttgctaaatttggtggaaccagcgttgccaattttgaagcaatgtctgcctgtgcaaatatcgttactgcagacgcaaatactcgggttgttgtgttatctgcttccgcaggtgtaacaaactatttagttgaactggcgaatggttgtgaagcagagcgtcgtgaagaaattttagcggcagttcgtaccattcaatataacattatcgaaaaattacaaaaccctgcggcagtttctgcagaaattgacgcattgttagaacacgtttcagccctagcctctctgcaagccttgcgacttcggcagccctcactgatgaattaatttgccacggcgaaatgatgtccactaaaatcttcactcagctattaaaagagcgtaattatcctgctgtatgggttgatgtgagagagattgttgccaccaataaccattacggcaaagccgcaccaaatgatgagaaaacccaagctcaatcagatgctatccttaaaccattaattgcagaaggcaaagtagctattactcaaggctttatcggtcgtgatgatgaaggcaaaacaaccacattaggacgtggcggtagtgactattcagcagcattgttagccgaagtgttaaatgcaaatgatgtgttaatttggactgatgtgccaggcatttacaccaccgatcctcgtgttgtacccgctgcaaaacgtattgatacaatgagctttaacgaagccgcggaaatggcaaccttcggtgcgaaagttttacacccagcgaccttgttgcctgcggtgcgtagcaatattccagtatatgttggcccaagtaaagccccagaacaaggtggtacttgggtaactcgagatccacaacctcgcccaagagcctctcccacaatttgtgtaaatacctgtttctgagataatacattcagacacaggtattttattatgaacgaaaaacaacttcacgccttggcagcggaatttgccaattaccattaaaacggcacagcacattaatttccccttgaatttgggtaagttcaataaggcggtcaagttagtccatcatttttcattaatacaataagcatgagctatctcaacttcatctgaaaaatcaccgcttccgcttggcaactaaataagaattttgcttgtaacaaaaaaccatcttcagtttggctaatttggctactgatgtcacacggatcgctttcaacttctcttgcttttgccgttaatgtggctagtccttgttctgcatctgcttgggttggatagacaagggctaattcaatggtgctgtccgcattgtcgaacatagacgtactacttggtttacaaataccaccacaacaatcggcttggtcactaaaggtttttgacatatttactccttgatattttgaaatttaagtaaagcgtatcataatatggtaatcaattcattgaggggaaacaaattatgtctatttctaaacaagctattcttgatgccttccattatcgccatgcttgcaagcaatacgatccaacgaaaaaaatcagtgatgaagatttccaatttattttggaaacagggcgtttatcgccaagttcttttggttttgaaccgtggcgatttttagtgattgaaaaccacgctatccgtgagcttattcgtgataatgcgtggggggcaaaggataaggtgatggattgtagccattttgttgtgatccttgttcgtcagcctgaaactctgcttgctgacggcgaatatgtacaacatattatgcgagatgttcaccatattcctgaagaagcgttaaaaatgcgtcaaggtttttatcgtaacttcagtgaaaaggattttggcttgacccaagatcctgtggcgttttatcactgggcttgtcgccaaagctatattgcattagccaatatgctaacagcttcagcaatgattggcattgatagcaccgcgattgaaggttttccattggaaaaaatggatcagctttttgtcgaaaaagggttgtatgatccgaaagtctataaacttagtgtgatggtcgcctttggttatcgtgcggtagaacctaaagcgaagacccgtcaagcaatctctgatgtggtgaaatacatagaataatgcttcttaatacaccaatcctaatatatccgaattaatatacctatgataatatccactacaaatatctaccttgtcggtggtgcggtacgggatcaactgctcggcttagcagtcaaagatcgtgattggctgattgttggggcaacgcccgaacagcttttagctcaaggctatcaacaagtcggtaacgatttccccgtatttttacaccctaaaaccaaagaagaatacgcccttgcccgtaccgaacgcaaaaacggcaacggctacaacggttttatctgcgactttacccctgaggttactcttgaacaagatttaatccgccgagatcttaccattaatgcgattgctcaagatcttgacggcaactaccacgatttttacggggggattgcagatcttaaacatcgcctgcttcgccacgtttcccctgcctttgctgaagatccgctacgggtgttgcgtgtggctcgctttgccgcacgtttccattctctcggatttcggattgctcctgaaacggtaaaattaatgcaagaaatgaccgcttgcggtgagttagctcatttaacagcggagcgtgtttggctggaaacccaaaaagccttcgccaccgacacgccacacatctatttccaagtgctacgagaagtcggggcattgaaagtgctatttcctgaagtggaagcactctttggcgttccacaacctgaaaaacatcaccctgaaattgatagtggcgttcataccttgatggttttggagcaggcgaaaaaattagcggctcgggcaaatgatcctgaaagtgtattatttgccgcactctgtcacgatcttggcaaagccttaaccccaaaggatattctgccccatcattatggacacgaacagaaaggcgttgccctaacaaaacaactggcaaatcgcttgaaagtgccagctcacactaaagcattcgctaaactggtaacggaatttcacacccataaccataaaatcacagagctacgccctgaaaccgtggtgaaattgtttaataaacttgatgtatggcgtaaacccgaacgtttttttgattttttattggtttgcgaagcggataataaagggcgtttgggttttgaaaatcgggaatacccacaagcggattatgcaaaacagctctatcaagtcgcttgtgaagtggatattcaagcggtgattaacgatggcttcgagaaagcggggattaaaagagaaattgatcacagaagacagctagttatcctagctaggaaagaggaaaacctgaactgtaagaagcccaaaacatagctaaataaagtagctttaatcccctactctccacgacttaaagctacttttgtctactaaaccctcccaaaccccttcaatccaacaacgtgtacatactcttggttattggtgatcttacgcactaacttgtaggttgtaccacgttctgggctgatgttttctggggcagcgatcagcaattgcatatccaaacgctcgcagagttcaaacaaggtattgatagaagttgcgtctaaacgagctgcttcgtcaaggaaaagcaagcgagcaggcagaatatctttagcacgcatacggcgagattcttcttcccaactttgcaccaccattaacaagatcgacatacccgtaccaatcgcttcccctgtcgataacgcactactttccgcacgcatccaaccgtctgcaccacggaaggtttcaacttccagatcgagataattacggtagtccaatagctcttcgccaatggtctgcggcgtacgttgccctagttcaatatgtggattaacacgcttgtagagcattgctaacgcttctgagaaactgagtttttggttctcaaacagatcgctatgttgctcacggtcgtttgataaagcattgagtaaaatcgcgtgtgtatcacgaatgtttaccaccaaacgcacccctttcacctgaccgaaggcaatattttgcaagccttggttcagttgcaaaatacggttttgctcacgctgaatggttttacgcaagatatttgccacactttctgagctgatcgccaattttttctcacggctagtcagttcgttggttaagcgagatagctcaatttccatctgctcaatcgcatcaatcggatcgtccgttttaatgatgtcttggcgaatacgctcacgcaaatgttggtaaaccaaaataaagaacaccactttattttcaggtttacggctatcttctgacgcacgcaagctatcacgcaagtattcgttatctgccacagcggttcgcaacgccccaagggctttatcggaaatcgaacgcaactcttctgccgattgataagcaagctcacgacgatttaagcgtttttctacatcgctattacgagagagtttcagcaccaaacaccagctcacttttgcctgtaccacaatttcacgttgagtatggtaatcacgctctgctttacgcaccgctttgttgagattatccatttccgcttgaataaccgccacttgcttatcaatataagatttacgcatacggtgttggcttaagcgttgttgcaattcatcacggcgtattctcgcacgctcttctgctccatcatcattgcggataccgtattcgtccatctcttgcaacaattcttgaagcatctgatttttcgcatcaaaggcactgcgtaacgacgttaaaacttggttatattcgctaaattgtgccgtcgcttggcgaagctgttcacgagcctgctcacgctcacgttgtgcattgtctaaacgttggcgaagttgttcgttaagagccgaaccttccgcccccaccgtttcttgatagctgaagtgcaaacggcggttcatcacatcagcaagggcaaagactttctgttgttgcaatttttgttgctcaacagaccgcttgtaatccgcttgtagctgttcaaactgggtcggatcgctctttaacgccactgcaatcggctcaagttgtgctaacgcattgccgaattgacggataaattgttcgtcttcctgtgcttctagtagctgttcacgacactcttccacacgatcttgtaaggtttcatcggcaagaatattgagttgtggcaacactttattcagcagttgcaactgggctttgctgttttcaagttggtgacgtaattgctgttccgtaccgcttgcttgattgagttcacgctcaatttcagcccgtttttgtgcaatctcttgcattgccacttcaggatcaggctggaaggctaaggctaaatgcgtcccgacaaactgactcaaatgttggtgtaaacgttggcatttctgcacgtcaaaggcacgttctgcgtgtttttccgttgtttcatcacgttcagctttcactttttcaagctgtttctcacgagaagcacgtccaaagaccgcaaattcagagaacttagagtaacgccattgacggtcagacagttgcactactacgccatcgcccagttcttccgatttaaagacattatcgtcaaaggcatttggatcaccttcgatcaaatagagattttcagggcaatcatcaagttgctgtaactgtgctttaaccgcttccaaatcacgcaccacaatggcgtggcgagcatcgccataaagtgccgagaaataaggtgcatcttcaatcgacacatcttcgtataactctgaaatcagcacaccgccaaatttttccgccagttgatttaagcgaatatcttccgccccgtcaggctgacttaggcgtgaaatttgctcatctaacaactgttcacggcgagcaagctcatcacgttcaagggttgcttcacgctcacggcttaaggtattttgcataaactgcataaccgcttggctactgtcaaaggtttcgccacactgctcttgcaagcgggctaatgccgattgtgccgtatgccacgccggtgcggtttgtgcaagttgttgatattgttgatttaattgctcacgttgctggcgttgtgttgaacgtacttcaacaaactcagcgagttccgcttccaaatcttcaaggcgagcttgttgctcttcataatagctttcaagatcttctgcgttttccaactctgcttgtgctttttgattaaactcggcaagcaaacgttctgcgttctgttgttgatgtaaacgctgttctaattctgttaatttttgacgcaaagccaccgcttgttgtgcgtgggctttttggcttggatacgcactcagcaattcacgggcaacgctgtctgcttgtaagcggtcagtttcccctgcaattttgcaaacgagttcataggctttgtcaaactgacttttcgccatatcggacaccgataaacgctgttcaagttcaaacactttatcggtaatttcgtcggcttgagccacaaactcagcgtgataatcttcgacattgtgcaaatctaaattagccagtccgctgatctgtttggctttttctaacgcattcaccgcttgctgatattgcaatgcacgggtttgctgtgcgtccaacgcctgttgataatccgccatttgagaacgcaactcttcaacctgatcttcggcttccgtcgcacgagcttgagccatctcttgacgttcctccacttcttccaacgccatttgttgttcttctaggcgttcgtttagctctgcaacatcatcttgataacgttccactttttcttgatggcgaactgcattcatcactaaattgagatgatcggaagcactattgtactcagcttcaaggctactttcgccctcttccaaatcctgcatttcacggctaaactcaaccaaacgttgctgttcaagggttaatttagatttagactgataccactcttgacgcttttcaattgcctgttgtacattgccacgacgttcgttggcgtgtcgcatatagtctgccgacacataattagtggactcggtaatcagttttttgaacatatcccgatctgattgcgtaaccttgattgcttcaagggtcatacggttttcacgcagtgccgactccatatcctgaaaggcttggcgaacgccagtattttcaggcaaaagataatcacgcaaagatttggtaataacgctagaaataccgccgtaaagggaagcctcaatcaacttatagaacttgctacggtcgcccgatgtgcgtaaacgttttggaataacgccaagatcaaagagaaaactatgataatcggtaatcgaatggtactgtttaaattgcacctcactgccatcaaatttctcttttagatcatttaacgccagcactcgtgcatttttctcaccaacctgctcagttaaaacagagataaccgattgattttcattgatattttgtaatgaaaacgaacgaatatcgactttcttatcacgccctgcgatctgctgtaaacgcacaccactaatcacacgttgcccacgggaattttcgctttccaacaccgcataacaaacgcctgctttcaatttaccgtacaaccctttatcacgagaactagaagtcgaacctgcttcggtggtattacggaagttaagcaaggtaagatcaggaattaacgccgtcacaaacccagccatcgtggtcgatttacccgccccgttaccgcccgaaagggtcgttactagttcgtccaagtcaaaggttcgagcaaaaaaaccgttccagttaattaaggttagggaacggaatttgccacggctcacactaggtatagacgattgtacatgtgtcgcaaccatgatattttgagaagtgacgttttgttcaaataagtcgtttttttctgtcatatatttgcctaaatactaaatttcaatttgatacagcttctcaacactgtctttatcatagaatttatgatcactttgaatgatttttatgctttcactttctgtaatttgaatttgtttcaatttttcaactaactggttaaattcatctgtatgagctagaacaaaatcatttatccccatgtaactattttcttctttacgtcgagcaagcacctcattttcagataaggtaacaacataacacaatgcttctcgatgcacatatttagtcgccatagcttctaaatctgcttgcttccaacgctctctaagagttgtttttgcactaatagtaataggggtcttacggttatataacacaatatccaaaataacattcggaacaaatgctaattctgcttgaacatatacaggtgatattttctctcttaacagagctagcacaagtaactgttcaaatacaccaccattaactgaattgttagattcaaattccgatgtgtacacattccaataaaaagaaatcaattcatttggcttccatttttgatttatcggatatttatgaaccattaattttactatatcggttacttttgttcctttcgccatattatctttatcctagccttaaatgctccaaaattttctctgccgttgcttgcactgcaggtattgcaactgaatttccaaattgcttgtatgcttgtgtatctgtgacagggataatataactatcaggaaacccttgtaatctagcccattctctaggtgtcatttttctaataccttccctattcacattaccttttatcttcgtagttggtgtaaagtcagtgattcgatgatctattaccaaatttctctcacgccccataccaccaacaacgatcgcatttgcaataccatcatcaggaataatctcatacccaaaaccattgcctttatcttggtggcgagctttgtgctttcttaaagtttcaatatattgtgttgataaataatatttcgttggtacaacatttttttctttcacatcattaaaacaaactttcctatttaatggtgcaggataataaaaagagtttatcgcaaggtcttgtctaaacccaacaataaaaattctttctcgattctgtggtacaccaaaatcttttgcattaagtattttaggatctggtacaaaataatttagatcttctcgtaacacatttaaaattgtgcttagtgttcttcctttatcgtggctactcaatccctttacattttcaagaaaaaatgctttaggctgatgtctgcgaataatttcagctacttcaaaaaataatgttcctcttgtatcttcaaacccccctctttttcccgcaatagaaaaagcttggcaaggaaatcctgcacatagaatgtcaaaggttgttggtataaggcgtttcgtttcttctaaagtaatatcgccgtatggtttttcaccaaaattagttgcgtatgttttttgtgcattttcatcaatttcactagaaaaaacacaataaccacctagcttctccatagcaagcctaaacccaccaattcctgcaaacaagtcaataaatgtaaattcagaatatgaaggaaatgcttctttaaataagttgtattgtattgagggttcttctactttctcatgttccattacaattaatatatcctcactattcttcaccatcatctatttcttcatttgcaaattcttcgtcaaaactgaccgcttgctctttcgcaatcgtaggctttgttgcctcaccatcacggattaaacgacgttgagcttcacgaggatcgtcccctgttctcacatcagccccaaaacggaacactgactctgaaatcacaaattttttgctgttttgatcgccaacacgagtaatcactcctaaacgacctaaacggcgtaatgccccacctactttctcagccagcttcgctttgtctaaatctgatcctgttgaacgtggattgattgctttaagcaacttgatttcgtccgccaaattaagcaactcatcgtacacttcgtcatagtggaaaatcccttgctgtgcaaggcgttctggactgagatagagataacacaacacttttcctaccaacatttccatttcagacatcgccgaacgagcaatcaaagttgttgctttaggtcgaagatagaaaaagccttctggtgcacgaataagttcgacgtgataacggcggtaaaactgttcaagctcgctttggtaatccatcaaaaaagcgtgttcatcaagggcttctaagctaatgtgtcgccctgctcttaattgactgtcaagttgcggaaaaatcgggttagcaatcgcttcagccaatttggttgaaataagttcttgggtgtttgtcattgtcgttctctatttttgtaaaactttaattaaaactgaccgcttgttatttattgtattggtcaatcacattcgcctgtacttctgcacctttatcattaatcgactgccattctgggtaaatcgcttggctgtcttggcttgccataccgagtttaacggcttgatcgacgataattcttgctacatcaaaatggcgagaaagcggatacattgccaactgttcacgcaaaatcgcaccgagatcaatcggtttgccttgttcacggaatgggacaagatattcttgcattgctgcaataatctgctcctgcacttgggtgagggactcatattctagctcagtcggtagctcgcctacggcttccgcttcatttaattcggtttcatcatcacgcagatccatcaaaggctctgctttggcaatataaagttgccacgggctttcaaaataatcttgaatagactggcgtaaacgttgcccaaagacacgatttttatccatatcaattgccgtacggataaatttatggacgtggcggtcatagcctatccagagatcgatcgcctgttgtccccaactaataatgcggtcaagtttattctgcaagttcacaatcagctgatcgacaaaatccaaatcatcacgcccaatcaagcaactttgaatacgcaataattgggattgcaacttatcccctgacgcatttaatacatcttgtagctcacgcaaattccccgaagtttcgtctaacaactgctgacaagtcgcaatggcttcgtgccaattttggcttaacagtgcagcaatacgctcacggatctgctgctgattttcgtccatcatacgctgggaaagatcgatactgtcaaaaatttctgctacagagaattttaatggggcaaacacttgattacgccagaaacgttcatcaccaccttcttctgctgcattagaggcgcgctgaatttcatcggcaacaatagaaagttggatcgatagacgtaaagtcgaaaattcacgttggcgaatgtaatactctgatacgccaacaccaagtggtgttaagcgataaattgccaaaccttcggtaaattcgctcgaaaaacggtttaaaaaacgttgtttgacaagatcgttgatcgcattattcgcacgctgtgtttgtgttgcttcagactgctcaaaggcatttgaaacatgacggaaaatatcttgtaaatcgctttcaagcaattcaccgtcagtgcgttcgttattatacagggctatcgccaataaaaatgccaagcggtcggaagaaagggaaagcgaaaattctcgctcttttgtccataaaatcagttctgggatcgtttgtgctaattcgtgttgcataggcgatattatttaaacataaaaataggcgttattgtaccttaatcagagcagaatggaaaagacaagcggtgagatttgtacaatttattacagatctcgccgcttatgggctattaactaaattatctcaataaatattggatcattaaacctgcaatatccactttagtcacctgttcaatcatttcaagcccagggcttgcattgacttctaacaccataatgccttgttgagaacgaataagatcgacacctgccacatctaagccgatggcttttgctgcttgaactgcgattttttgttctgcatcagacagttgaatggcttgggcggtgccacctctgtgaatattggctctaaactcaccgcttgcaccagtgcgttccattgttgcaacaacttgatcgccaatcacaaaagctcgaatatcttgccctttagcctctgcaataaaggtttgtaagaggcttggtactttggcactttttaatgtttcaagtaaactcaaggcaccgctgtggttttctgccaacattacccctacaccttgagagcctgacagcgttttaataaccgctggcaagcctgattgacttaaaccttcagcaacgctgtaaagctctcccattaatagcgtatcaggtactggaatgccacaggcggcaagtcgctgtaggctttgccatttgtcacgggcaagagcaaaggcagaagacgcatttaaaacaggtacatgtttttgttcaaaatgccgtaatacattacagcctatttctgtgctagttgtaccaaatcgaggcaagatacctgcatattccccgattttttcgggttttgctcgagttttatcgtagctttcccctgtttgataataaagctcaaaccgcccttgctgcagttgtagcaagaagcggtttggatcgagaatatccagttggtagcctttatgttctgccgcttgtttaagtctttgacaaccatataaacgaggctcacggcagagcattaataattttttagcattcattatgcgtaaggctgtaactcagggttaattggtgtatctgcgaggttgtttgcatagttacataagctggctaggctgacaccaagtaccacatctagagcattttgttgggtgtaacctacggcaaaaaattcattgagtagggtttcacccactttgcctttagttttgataacagcgagtgtaaagcgtgcaagggtatctaatttgttatcttgaattggcgtagctttgcgtaatgcttgcagcaattcgtcaggcattttgatctgtttaatggaaattgcggtatgccctgctacgcagaaaccacaaccatttgcgaccgctacggtaatttgtacgacttctctctctgttggcgttaagctgttacgttggttaattgccccgacggtgcgataggtttctaaggcggtaggtgcattggctaatacgccgattaagttaggaataaagccgttattgtttttaaccgcttgtaacgtttcttttgctgcttcaggtgcagtgtcgatagtatgaatttgaaatttagacatagtgaacctctataataaaaaaataaaatctgtcaaaaatctgcgattaattcaccgcttgtaaaatggtttttaattgtaacacacttggggtaacgactggcaagaatgccccttctcgccaacggcgaataaagctagtgccgccattggtaagatagcctctcccaccagaagcctgtaattcaagtgttaaactttgtacaacaatatcgacaatttcaatccgaatttggaagagtactttagggtgttgcacaaaatagctcggatcagctaagccctcggctagtcgttgctgtaaagcggtcagttgttgcgttaaattttcccagtctgtttgtaaaatggaacgattggaattgagtgtctgtttgacttcgttaagagaacgttgagccaaaccaaatgccattgcacattgtaaccctaagaacgcagggcgaacattaactaagtaagaagaggcatcttctgcaataatccaatttgggtctaattcgacattttcaaaatgaagggcaacggtgttgcttccttgcaaaccaatcagagataactcttttgttctggttagccccgttgctatggaaggtaatgcaatgataatcggggctttgctattgtcggcatacgatgcgacaaagatagtaataaaacccgattggcgtaagttagtaacccaaggcaagcgtccgttgaggtaatatttgccgttttcgtgagtaatggtcacttgtaattcttcaatgcccgacagaaacttgacggcattcgataaccctgttccccctgcacgtttgccactaagtaaatcggctaaccattgttccttcggataactatttgaacttgcaagtaaattttcaattaaggtgcggtgtccccaagagataaaacctgcagttaaagagatttgcgaaaccgattggatagcgtgaatggcatcttgaatggtgccaccgcttccacctagttgcgaaggcactccgattttgaaaatcccttcattggcaagacgagtaagtaattcgtctgcatattgattagactgatcaagatcatctgcgtgctgtgacagccattgaataaattcagcggaaagatatgacatagcgtactcctgtaaaatgaaatttttcacatcttaggtaaaaataatatgacaaaaaaatacatttttaagatgttttatgctttttagttatatttaagactagaataaatttatctttcttataactggatattctttccttcccgtttgcttttcctctatgttgtattccacgtcttatttcaatgtgtaaaaaatggtgttaaacgtaaacaatgtcgcaataggctatccttcttcaacggggataaccccaattttgcagaatacttcatttaatgtggaacaggggcaactcacctcaattttaggtgcgagtggtgtgggaaagtcgtcgttattacgcgtgttggctgggttagataagtccattgaggggaatgtaacgctctttggacaacctgttaaacagccacttgccgagatcggttatgtgtttcaatcgccaacattactaccttggctgaccgtcgcagaaaatgtggctttcgggctggattttgtctgtcagggacagttggcaaagaatgaaattaaacggcgagtagcagaggctctagccgatgtagcgttgagtgatgttgccaatgttcgtccaaatgcattatcaggtggaatggctcaacgggttaatttggctcgtgctttagctcgaaaccccaagttgattttgttagatgagcctttttccgcacttgatcctattactcgtagccaaatgcaacaaatactacatcatatcgttaaacagcgacaagctacggcggtgatgattactcacgatattgatgaggctctgactgtatctgaccatattttattattgagcggtaaaccagccacaattaagggaaaatggcatttaccttacgcctttccgagaacggatttgctggctttaaaccattatcgtgtggatattttgcaacaaatgcaagctacaccacaaaacaatatcgaatatcttatttaggaggttgtatgaacaatgaacgtcgagattttctgaaactattaagtttatttacccttgcaggaagtagcccctttttgcaggctcaagagcaacagcgaaaaattaatcataacgcaccgcttaaaattggctatttgcctataacagatgcgacaccattgctggttgctcacgctcaagggctctttgaaaaatataatgttgaagtcaaaaaaccgattatgtttcgtagttgggctcaacttattgaagcctttttaagtggcaatgtaaatttaattcacgttctttcgccaatgagtttatggacaaaatatggctcaaaagcaccagtgaaagtcgtgatgtggaaccatctcgctggttccgctttaactgttcgccctgatattcaaagtattgcagatttagcaggtaaaactatcgctattccattttggtactctattcataatattgtgttgcaacagctactcaaagcacatcaattgacggtaacagaacaagagcctaaagcaaatgaggtcaaactgacggtgcttccaccttctgatatggtcgctgcgttggcaagtaacgcgattgctggttttatcgttgccgagccgtttaatgcgatagcggaagcaaaaggtgtcggaaaaattcttcgttttagcggtgatgtttggcgagatcacgcctgttgtttaaatctaatgcacgaacaagatgtgaacgaacgtccagaatgggtacaaaatatagtgaatgcggttactgaagcccaagttttcattttggataatcgtcaagcgacagcacagattttggcaagaggaaagggttatacccctcacgatcaaaaagtgttagaagcggtgttagatccaactgaggcacaatggcaacactacattcaaactggggctattcgccacccacactggcatcaagaacgcattggttttcaaccctatccttacgatagttatatggaaaaattagtagagctacttaaagaaacccatatcgcaggtaatagtgatttcttagcctcacttgatccaacacaggtagcaagagagcttaatgcccctcagtttgtacgcaaagcgattgaaaatggcggttggagcgacaaattcaaattgcaaaatggctggacaagaacagaagaaattgcggtgtaataatgaaaagaaactatctatatggatttacaggcttaatatcgcttgttctcttttggcaggctggcaccctgttgcttgctcaacatattcaaattgcgactgatctttcgcccttgcaaacgctcaacagtttatatgctctgagtatttcaggggaaatttttccgcatatttgggcaagtgtgcaacgtattattgtgggtttaacggtagccttgctttgcggtattccgctgggtttagctttggggctatctaaaaccttagaaatgtgttgtacgccagcttttcaatttttacgaatgatctcaccgctttcttggatgcctattgtggtgatgtttctaggggtaggggatctgccagtttactttttgattgcatttgctgcaatttggtcgttgatcctttctactgcatcgggggtaaaaagtattgatccgcaatggtttttacttagccgttccctagcagcttccaagcgtgaaaccttatgccatattattgtgccagcgattacagggcatattttaacagggttaagagtttctttaggcattgcgtgggtagtgcttgtgccttgtgaaatgttaggggttaatgagggtttagggtattttattctggatactcgagatcgattagcctattcagaattgatggctgcggtgatcgttattggcttgattggctggggattagatagtctattacgccttgggattagaacaaaatagccctgaatgtcaaggctaatagctacaatttttctaaataatttattccgccgagattattgacctgtcgcataatccattgttgccgagatcgcattgtttgacttggtattttaacccgataaatcatcggatttggcaaagaggcagccaacaaggaagcctcttgtaaactaagctggcttgctgatttcttaaaataatgtttagctgccgcttctacaccaaagataccatcaccaaattcagcaatattgagatagacttctaacactcactgtttattccaaagcaattccactaaaaaggtcaaaggcacttcgatcccttttcttagccaacttgttccgtgccataagtaaaggttctttaccgtttgctgagaaatagtggaagcaccgcgaggtttcttttgagatttactatttcgcttaattgctgcttcaatcgcatcaaaatcaatcccaaaatgaattggaaatttttgatcttccccagcaataaccgacatttgcatttgccacgaaatacgatcaagactaacccactgatattgaattttatataagtccccttgtattaggtgttccacttttttctgtagcatataagctgaaaaaggcacgggaattactgaaaatatcaatgttaaagaaacatagaaagttgtgactgccacaccaatacgactaacgccaaaccaaagccaactttttaaagatagcatctgtttgggaataaaaaagcggaaaatagattgtagcaaggatttttgcttaggttttggtgccattcagttttgtatctatccactttaaaatatctggctcaacagtttttaacatatttgaaccccgtgtaatagtcgccgcactagtattcaattgctgttggatttcacgctgagaaatttgattttcgagcaatgcgcgtacaatttgcactcgcaatcccaacgaagttcgttcgtctgttgtcaataacatcgacaataatgcatctgttttatcttctgccaccgcttgttttagcagtgccacaaattgttgccactcttttggatcacgttgttgataaagggttctcatacttacttatcctgttagtacaatagtacggtaagatctgcaaaccttaccgctttactctttgttatgcttattttttaccacgctgatcgtctaattcagcccctttaggcacactaaaactaaacagactttcagataaatgagccgttgaaatgttgcgtaatacatagagattactttgcccgtcacgttcaatagtgctaaatcctttgactaaaccagttgcatcaatacgaatatcaaattgtttgatcgcactttttttcgattttggttttaatacaaaattatctacattttgtgtgacatcatattgatcccagtggcttttatcattgcttgttaaaagtacaaatggtgtgttgctcacagcatctttgacccaatttgccgttacctgagatacaaaaggatcgtaaaaccacaaagttttgccatcagatacaattaaattttcttgaggactttgggtgtccatacgaaataagttcgggcgtttgacttgaaacttaccttgccctttttgaatttcctttcctttgcttgaacggacagtctgctcaaaatccgcactgtattgcattgctttatctaaacgttgttgtaactctgcgacagcttgagcatcagcaaaagcaaagccatttaatgagagaaatgctaaacctagcaacgatttttttaacaaatttttcattgatttccctttaaatatttatagaaaagtgtctatttgacagcaaagccataaaaagttcttagaaacggatacccgtaccgatacctaagccaataccgaccccattagaaccaccacctgcattcacacttccaccaaaagtacaacctgcgagcattaaaatagaggcaatcacgaatatttttttcatatttatccctttgtattaaaaactattataaactttcagtttcaaaagatgcgcattctactctgttttaacactttaaaccaattccaaaggagattttatgaaacttttacataaactgagcttactcttgttgataatttttcctatgactactcaagcgagtccgttgagtatttcagagcaagaaatcaatcaatatttggctacgcgtttagcagaaaaagtgcctttgcaagatagtttaggtgtaccaggactatttcaactagactataaattatctgatttatatacaaaggtgggacaaacagatgaaaaggttgttgatatttcaggcatcatcgacagtctattacagataaagggtaaagaatatcaagttaaacttaatataaatatggatactcttcctttctatgatatggaaaaaggtgcactatttctaaaaaatgttcgtttaaaaaattggaacgctacccctgaaaaatatcaaaatgaacttcaggtgtttttaccaataattgctgatggtcttacaaatatcttaaatagccaccctgtttatacattagatgaacgcagaacaaaagaatcccttgtaaaaaaatttggaaaacatattattgttgaaaaaggacatattcatttagaaacaaatattttttgataaagatccctcttattttaaataagagggattttgcattctattcctttaaaaaaaccttccaacaattcatttaaaaataatttgccgtgctgtgtaatctgccaagatgtattgttttctgtgataaaatttctgctcaatgcccagtccattgtggcttgaacctgcgtccgatctagccccgtatatgcctcaaattctgtttttggggttgcttcaagtaagcgaaaacggttcataaaaaattcaaaagggcgatcatcattttcaatcatctcttgatgataacgatactctcctcgcatatagcctttggggtgcttcgttttgctaaagcggtaaatttcccctgttggataacttattttcccgtgagccccacaaccaatcgctaagtaatcaccaaatcgccaataattcaaattatgctgacattgatacccctttttcgcatacgcagaagtttcatactgttcataacctgcgtcagttaaaagctgatgcccttgttcaaaaatatcccaaagctcatcatcgtcaggtaatgtgggctgtcgatagtaaaacatcgtattcggctcaatcgtcaattgataccacgaaagatgtggtggatttaacgcaataccttgccgtaaatcatcaagagcctgagcaacagattgatttggcaatccgtgcattaaatctatgttgaaacttctcaagcctactcttgctgaattttgagcaaatctaaccgcttgttttgcttcattgctatcgtgaatacgccctaatttcaataatttctctggttcaaaactttgaatacccattgaaatacggttcacgccaccttgtacatacccgataaaacgttctgcctcagcagtccccggattagcctctagggtaatttcgcattcgtgagaaaaatctatccgcttgcgaatttctgcaagtaaataatgaataccttcagcggaaaaaagactaggcgtaccgccaccaataaaaattgagtggatcttgcgatcagcgattgctgttttatagcttatgagatcttgctcaagatcattgagcaaatgctgaatatattcttgctcaggaataatgcccttttgtgcgtgggaattgaaatcacaataggggcatttttgtacacaccaagggatatggatgtataggcttaaggggggctgcattaaattcaccatatcttccagtatataaaatccaaataaaaattcttacatatagtactagtataacacctaagatatcacaaagctttccttatcaatataaaatcagtctccttaaaaaattaggatgattgttcacatatacaattatgcctacctatttttaaaataacctattaatttgatttactctccagataatctcaaacacccaactctttaaacaaccgtctgcaagctgtaccgtcttctttgaataagtggcaacggtttgggttgataccaattgacatttcatcaccttcttcaactaatacgatgtcgttttggcgataaacaaggctttgtttgattggtggcatttcaaggtaaatttgggtttcgtttccaagttgttccactacttttactgttcctttaatgcacacttcactctgatcacaaggcagtaaatgctctgggcggatacctaaagagagattgtcgccgatattcacacctgtgttatctactgggatccagaagttgagatgggtggagtcaggtaattcaatttttacgccaccttctcttacatcaatcacttttacaggtaagaagttcatttttggtgagccgataaagccagcaacaaagcggttggctgggtagtgataaagttctaatggtttaccaacttgagcaacgttagtggtaatttgtgtattgtttccgagcgcttgtaacaccacgattttgtctgccaaggtcattgcttccacttggtcgtgggtgacataaatcattgttctacctaattttttatgcagtttggaaatttctactcgcatttgtacacgaagggcagcatcaaggtttgagagcggttcgtctaataaaaacacttcaggttgagaaacaagtgtacgaccaatcgcaacacgttgacgctgaccgccagagagttccttcggtttacgttgtagtaagtgagcaagttgtagaatttctgcgacttggtttacacgttgctcgatctctgctttcgctttaccagccagttttaagccgaaggacatattttcagccacattcagatgtggataaagtgcgtaagactggaaaaccattccgatattacgttgagcaggtggcacatcattcattcgggtatcaccaataaagagatcgcctgatgtaatatcttccaagcctgcaatcatacgcaatagggtggatttaccacagccagatgggcctacaaatacgacaaattccccttctttaatatcaaggttaatattgcgtgagatatgcacatcgccgtatgatttatttacaccaataatttttacatctgccattgtcttatcctttgccttagggttactactttttgacgggtgccaagattacttatttcctcttgtcttgaaatcatactttgtgaaaaaatttttcactaccttgtaaaaaattttttcgcagaaaagcagattttttgtgacttagatcacaaattcatacgctttttttgtgatccatttcacacttattttaaaaacaatcaaaaatgtgatacagatcactaaaaggataaggggggaggataagggggtatgatgaagtatgagaagaaatcctccactattcgactgtcaaaatttcatttcactaaactgagggaaaaacaatgaaaaaattaaccaaagcagcattagcggtattagcaggattatgtatcgcacaaggtgtaaatgcaaaattagttgaaggacaactcaacatctggatcaatgccgataaaggttataacggcttagcagaagtgggtaaaaaatttgaagcagaaacaggggtaaaagttgttgttgaacacccaagcaaattagaagaattattcccacaggttgcggcaactggtgatggccctgatattgtgatctttgctcacgaccgttttggtggctatgctcaatcaggcttattagcagaagttcacccaagtgcagaattcaaagcaaaattatctgatatcggttgggaagctacaaaatataatggtaaacagatcgcttacccgattgccgttgagtcgctctcattgatttataataaagatttagtaccaaatccaccaaaaacttgggaagaagtggagaaattagataaagatctcaaagcgaaaggcaaaaatgcgattatgtggaacttagcagaaccgtatttcacttggccaatcatctcttctcaaggtgcttatgcgtttaaagtgaccgcaaacggctatgatgcaaaagacatcggtgtaaataatgaagctgcacaaaaaggcttacaatttgtggttgatttagtgaagaaaaaagtgattaacgcagacaccgactactctgtggctgaagcttctttcaataaaggcgacacggcaatgactatcaatggtccgtggtcttgggcaaacattgagaaaagcggtattaactatggcgtagccgtactaccaaccttaaacggtaaagcaggtaaaccgttcgttggcgtattaagtgctgcggtaaatgcctcaagcccgaaccaagacttagcgaaagagttcttagaaaaccacttattaacggatgctggtttagaaaccgtgaataaagatacgccgttaggtgcagtagcacttaagagctaccaagcaaaattagcggcagatccacgtatcgcagcaacaatggcgaatgcggaaaatggtgagattatgccaaacattccacaaatgagccgtttctggtattcagaaaaagcagcgattgacagtgcaatcaacggtcgccaatctgtcaaagctgcattagatgaagcacaagcgaagattgaaaaagagtaatttttaataaataaaaaatgtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttagcgttattggtttcggttttggtctttttctgatgggaaaaaccaatcacgaaattgcgtttagcaacatcaataccacaataaatcggagcgttcatcggtaacctgccttgtattcgggtttatatttcaactgttcggttttgctgatgaagttatccacgcctacgctacagaacgagttttagctctagggacacccaagctgtggataacgttatggtttatgttgctagtttactataattttaatatacaagggacacactgcgtgtgtccgttaaataatccaaattagacggacacaagcagactagtggacacacgcagtgtgtccctacgagtatcaagcggtcacattcttctcatttttttgcaatttcctcttcgcagtactaaaacaaggaaaataaaatgctaacttcaactcattcctcgatttcgtctgctcaactttggggcaaaagggcttttgtcggattactttacctacttgctttttacttggtttttacaatttatctgcaaggtgaaattttatttgcattactaaccttagtcgtagtggcttcaggtatttttgtgtttagctcagaacgggcttatcgctggcgttatctgttcccaggcatatccgcaatcggcatatttgtagtctttccacttgtctgtactgttgttatcgcttttactaattacagcggttcaaaccagctcgcctttgaacgtgtagttaatcaattgcaaagccaacgctatttttcaggcgaacgttacgatttcaaattacttgaaacagcggataatcaatatcagcttgcccttgaaaataaaaatgtgcaaaaaacttacctttctgcaccgcttgcactagccgatttaaaaggggaaatcaaattagaagaagtggcaacattgccagaaagcaaagttgcaccgtttaaaaccattacccaaaatcgccaacaacttcaaacggtgaatgcgattttaccaagcgaagaaatgctcacgatgagttcacttcgtcaattttctcaacaaagctaccgctttagctttgatgcagagagccaaattttaaccaaccacgaaaccaatgaacgttataaacccaatgatgatgtcggtttctttgagcaaattgatgagcaaggtaactttacgggtaaacgtgttgagccgggttatacagtagcaattggctggcaaaacttcgtgaaaatcttaacggacgaaggtgtacaaaaaccctttattcaaatctttatttggacagttacctttgcattcttaactgtcgtgtttaccacattactcggtatgattttcgcctctctagtacaatgggaagcgttaaaaggcaaagcggtttatcgtttactgttaatcctgccttatgcggtaccaggttttatctctatccttgtatttaaaggtttatttaaccaaagtttcggcgagatcaacttaattttaaataacttattcggcattcgtccggaatggtttaacgatccgttcttagctaaagtgatgattttaattgtgaacacttggttaggttatccatatatgatgatcgtttgtatgggcttacttaaagcaattccgcacgatttatacgaagcctcggcgattgatggtgcatcggtatggcaaaacttcaccaaaatcacaatgccgttgttaattaagccgttaatgccattgatgattgcgacctttgccttcaacttcaataacttcgtgttaatccaattattaacccaaggtcggccgtcaatgatcggaaccagcacaccagcaggacataccgacttgttagtcagctatacctaccgtatcgcctttgaaggtagcggtacgcaagacttcggtttagcggcggcaatcgcagtaatcatcttcttactcgtcagcggattagcgttgttccaaattcgtttgactaaattacaacaggattaagggggataaaatggctatcgttcaacctaaatcaatgaaagcacgcttatttgcaacacatttctttcttattgtgttctgtgcattgattatgttccctttactgatgattttagggatctcacttcgcccaggtaacttggcattaggggaaattatcccaagccaaatttcccttgaacactggaaactggcactcggttttagcgtcaccaatgcggacggcactgttaccccaccgccattccctgtgctactttggttatggaactcggttaaagtcgcaggtgtcacggcaattattaccctagcactttctactacggcagcttacgcttttgcacgcttacgctttacaggtaaatcaatgctgttacaaagtatgttgattttccaaatgttcccagcggtactttcacttgtggcgttatatgcgttattcgaccgcttaggaacttatgtgccgttcttgggcttaaatactcacggtggtgtaatcttcgcttaccttggcggtatcgcaatgcatgtttggacgatcaaaggctattttgaaaccattgataaatcgctcgaagaagctgcagcacttgacggtgcaaccccgtggcagacattccgtttgattttattaccattatctgtgccaattttagcggtagttttcattcttgcctttatctctgcaattatcgaagtgcctgttgcctctctcttattgcgtgatgtggaaaactacacccttgcggtcggaatgcaacaatatctacacccacaaaactacctatggggagatttcgcagcggcagcgattttatccgccattccaattaccttagtctttatcatcgcacagcgttggttagtcggcggattaacggcaggtggggtgaaagggtaaacataatgggacacgaagcgtcgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgctaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtatgcgtaaactgctaaccattatgaatgcgttggttagacgcaatgaaaaatgggacgctacacgctacttatccacagaatctgtgggtcaaaattgaataacttttttgtgtgtaaacacagttgctacaatcacttcgtagatatttaagtagggacgccacgcttggcgtccgtaaataaattaccattcgggaaacaataacaatgaaacaaaatcacccatttttaaatcgttacttcgtggatgaacacggtcgccgtgtttatgcccaaccgtccgtttatggcaaagtggcaaaattgctcggtttgcaaaaaagtcgcaaaatcctaccgcttgtcaaagttgtcaaacagggcgagcaagtttttattccgctttttgtagcggacaaaacccaaaccgttcacgcaaactggacgctgacccttgaaagcggtgagattttaacaggaaaatgcaaacgcaatagcattgacctgcctcgtgatttaccccttggttatcatcaattaagcctgaacggcaccaccgcagaatgtcgcattatcgttacgcctgaacgtgcttaccaaccgcaagagttggcagagcataaaaaattatggggagcaattttacagctttacaccctacgttcagagcaaaactgggggatcggcgatttcggcgatttagcggagtttttaacgaaattagcggaaaaaggcggtgattttgtcggcttaaacccaattcattcattattcccagctaatcctgaaggggcaagcccttacagcccatcttcccgtttatggcaaaacattgcttacatcaacgttggggcgattaacgctttccaacaaagccgtgaagcacaagcgtggtttaattcggcggatattcagcgccaattacacgaagctcgccaaaaagattatgtcgattattcacaagtgatgtggctgaaattacaaggcttacgcttagcctacgaacaatttaaacagcaagatcaaaccgctttcgaacaatttattgctgaaaacggcgaagccttgaaagtgcaaggtacttttgacgctctacatcaatggctttcttctcaattcagcgaacaatggggctggaactgctgggatgcaaaatatcaagattatcacaccgcttccgtgcaacaattccaacaagaacagagcgatttagtccgtttctatatgtggttgcaatttgtggcacaacaacagcttaaagcctgtaacgaactggcaaaacagctcggtatgccgattggtttctaccgtgatttagccgttggcgtagcggataacggagcagaaacctgggcggataaagatctgttcgtgttaggtgcatctgtgggtgcaccaccggatattatggcaccgcaagggcaaaactggggcttatcgccaatgcaccctgaagtattgcaagagcgtggctatcagccgtttattgacctactgcgtgccaatatgaaagattgcggggcgttgcgtatcgaccatattctcggctttgcccgtttatggtgggtgtcgaaaggcgactcggcgaaaaacggcgcttatgtgaaatatccgttggaagatttgctttcaatcttagcccttgaaagccaacgccaccaatgcttaatcatcgcagaagccttaggtactgtgccgaaaggaatgttggaaacccttgaaagcaaaggtattttagcctacaacattttctattttgagtacgaccatcaaggaagcaaaccattagctaactatccgtatcaagcaatgaccaccctaagtacccacgatttaccaacggtacaaggctactggaaaggctatgatttcgagttagggcaaaaatatggcgtttacccgaatgagaaagtgctgaacattttaagaaatgcacgccactcaaataaagaagcgatccgccgagccgttgaagcggtacaaccgctagaagcagatagtgctggcgttacacaaaccttcaaccatcagttacaaagctatgtggcagataccaacagcgtattattcggttcacaaccggaagactggctaaatatgctagagccggtaaatatccctggaacaagcaccgaatatccaaactggcgcagaaaattgagcaaaaccacacaagagatttttgcggatcagacgattgtgcagttgttagaaaagattgaggcgaaacggagaggaatattaaattaaacttagactctattgtttttgaaaaatcataaccttcttatatacttgccattgcaatagctatataggaaaactagtacaatctgaatgtttcccccctcaattttgcaaatttaatttgccaaatgcagagagttctgttatttatacgcgctttcaaaacaccctaaatagagcggtaaaattagggaagaaaaattccaaaaacaggagtgaaatatgacagtggcaaaacccacttctttaagtttattagcccttgcgggcgtgtcgccttaccaattaggtaaagacgaagagtatatgaatgaagctcaaattgagcatttccgcaaaattttaaaagcgtggcacgcacaaattatggaggaagcggaacgtaccaaaagtcaaatgcaagatgaagtgactaacttcgctgatcctgctgaccgtgcaacgcaagaagaagaatttagccttgaattacgcaaccgtgaccgtgaacgtaaattgcttaaacgtattgagcaaaccttaatcaagttagatgaaggtgactacggttactgcgatacttgtggtattgaaatcggcttaaaacgtttagaagctcgcccaacggcagaactttgcgtagattgcaaaacccttgcagaactgcgtgaaaaacagatgggcggttaattaagtagggtgggttttaacccaccacttccgcatataaattgaaacggtgggtcaagacccaccctacaattttatataattgaggtgatctattttaaattacatcaaatctttttttagtcgtaaaaaaaaggatacaaactcaccgcttgttgaaacagatcaagcgaagaaagttgctcgcccaatgcgttcagccccagaattgactgaaccgcaccgacacacatctaagaagaaatcgaaccataagcaacaagccgtaccgtcccatattctgcataaaaaatttacccaacctgcagggcattacggtatttctccaaaagattttccaagtaacaccattgccattatcaataaacttcaaaaaaatggctatgaagcctatatggttggcggttgtattcgagatttattactaggtcaaaaagccaaagattttgatattgcgaccaatgctcgcccagaagaaattcaaaaaatctttggtcgccagtgtcgcttaatcggacgacgcttccgcttagcccatatcgtctttgggcgtgagatttacgaagttgccacattccgagccgatcatcacagcaatgcgacggaaaaaatgtcgaaaaccagcgaagctggaatgctgttgcgagataatgtttatggcacacttcgggaagatgcagagcgtcgtgattttagcgttaatgccttttactatgatgttagccataatttgatctacgattttttcaatggcatagacgatctgaaagcaggaaaactcgccttgatcggcgatcctgttactcgttatcaagaagatcctgtacgaatgttgcgtgcaattcgctttatggcaaaactggatatgttcctagataaagcgagtgatgaacctattcgcaaaatggcagtattactgaaaaatattcctgccgcacgcctatttgatgagtcgttgaaattactgcaatcaggttacggtcacaaaacctacgagttattacgcaaatatggtttatttgaacaacttttccctgtattaagcccattttttaccgaatatggcgacagcaacagcgaaagaatgatcagcaaggctctcaattccactgatgaacgtattcgtgacgatttacgagttaatcctgcctttttatttgcagcgctactttggtatccgctacgcgagaaaattgacgaattgaaaaaccaaggtggtttaaacagccacgatgcaatgatgttggctgccaatgaaattttggcagagagtgtcaaagcggtcgcattacatcgtcgttatacgaccgttattcgtgatatttggtcattacagttccaatttccaaaacgtacgggaaaacgtccacagcaaactctcgaacatattaaattccgtgcaggctttgatttactcgtgatgcgagctgaaattgaaggtggtgatttagttgaattaagtgcgtggtggcacgaataccaatttagcaatgaagcacagcgtgcggaaatgttaaaaacagtcaaacagctaccgactttccgtgacgaagaatcaaagaaaaaacgtcacccacgccgtaaattcaaccgtaaaaagaaaatcgtaaaaggggaagaatagtgacaaccgtttatgtggctcttggctctaacttagaagatccgcttgctcaacttaagcaggcggtcgcttcgttgcaaacctttgcaaaaaatctaaaagttagctctttttacggcagtaaaccactcggcccacaggatcaacctgactatgtgaatgccgtggtaaaattcgacacggatctcaccgctatcgagctacttgataaattgcaaagtattgagaatgaacaagggcgagttcgtttacgtcgttggggagaacgcactctcgatcttgatattttgctctatggcaatgaacaaattcaaagcgaacgtctaactgttcctcactacgatatgcacaaccgagagtttgtgattgtaccgttatatgaaatcagtcctgaattggttttgccgagtgggaaatctttagcacaactttatccgcaatttgcagagcatcagatgaatataatagttttataatgccgattattatgtaaaactattaataaaattgataaataggtagcataataagtggcatagtagacaaacatattctgagttttgtatgttagtgagaaactttatttaatttatagttataccaactttttaacacattccccttctcatcacaaaactcaacaaagttttcacggactttaaatttaaaatcattacttaaatgaagcacatcatctttatcctgatcccaaacataactccctttttctgtaaaaggatattgctctttattcttaaaataaaccgtgttgtattgataggttttatcactatttaaaattaattgtgcttcgattttttcgcaatctgcacaaggtagtgtgccttgataagtgccagaaacagttttttgaggccatatcgaacaggcatttaacattgcgataatactggcaaatgcaatttttttcatagtcatatcctcttaggttaagcagatttaaaattaggatttaccttaaagtctaaggcggttacttcaggaaaatctgcctgaattaagtgtaatagaacggtttgctgcaacaatagcccttgacgaacagtgccattttgtacttcaaatctaagtaaattatcggataaattcaaaattcggtaaagtccacggtattgttcgggcagtaattgctgaatttttcgatttaattcattgagttcattggctcgttggacaattttcgtcaagctagagttctgcaaaatctcattgatattttttattgttgaatttttcatctttcctgctgtgctttaacttgtttttggtgagattgcccttatattctgcctattctacaaaaattgtcgtataatcaacattatttttttattgagtgctaaatgaattttttacgtcgctttcataaacctgcattgatttcgcaattcctattagggatcgttgcgatttttgcgttacctacggctcagccgttagcgaatgaaagtgaaacattgcctacaaatcaacttgtattacgcttaagtgatttttcttcaattcaaaaagttgagttagaggcggcacatttactacatttagaacaacaacctctcgttattccaactaaacaagctgtggttttttgcgagttttttgcaaaatcataccgcttgtatcaagtatcaaatccgccgattagggctggaccaacagcgtaattcttctatctccctcccccgcaagcagggggagcgtaaactcgttactaatacttattaccttatattttattggaaaaaattgatatgtttacaaaattaatgactgctatttttggtagtagcaatgatcgtactttacgccgtttaaacaagcgtgtcgcacaaattaaccgtttagaagctgaatttgaaaaattaaccgatgaacaattacaagcgaaaaccgctgaatttaaacaacgtttagcagaaggggcaacgctagacagcttattacacgaagcctttgccactgtgcgtgaagcgagtaagcgtgtgctaggtatgcgtcacttcgatgtacagttaatcggcggtatggtgctgaccgaacgtaacattgcagagatgcgtacgggtgaaggtaaaactttaactgcaaccttaccttgttacttaaatgccttgacgggtaaaggggttcacgttgtgacggtgaatgattacttagctcgtcgtgatgcggaaactaaccgtccgttatttgaatttttaggaatgaccgttgcggtgaatatcccagggctaccgtccgatgttaaacgtcaagcctatttagcggacattacttatgcaacgaacagtgagcttggctttgactatctgcgtgataacttggctcattcgaaagaagagcgcttccaacgtccattacactatgctctagtggacgaagtggactcgattttaattgatgaagcgcgtacaccgttgattatttcaggcccagccgaagatgcgacacaaatttatcaagcgattgataaagtcattccgcatttaattgctcaagataaagaagataccgaagagtacacaggcgacggcgatttcacccttgatctgaaaagcaaacaagcccacttgaccgagcgtggtcaagtgaaagtcgaaaatattttgacggaaatgggcttaatgcacgaaggggaaagcctttatcacccagctcgcattagcttattacaccacgtttatgcagcattacgcgcccataaactgtttgaagtgaatgttgattatatcgtgaaagatggcgagatcgtgatcattgacgaacatactggtcgaacaatggctggtcgtcgttggtcagatggtttacaccaagcgattgaagcaaaagaaggggtaagcattcagggcgaaaaccaaactgttgcctctatcacttatcaaaactacttccgtctgtatgaaaaattagctggtatgacgggaacagcggataccgaagcctttgagttccaacaaatctacggcttagataccgtggtgatcccaactaaccgtccgatgatccgtgacgacaaaaccgatttaatgtttaagagcgaaccagagaaattccaagcggtgattaaggatattcaggattgtatggctcgtaatcagcctgtattagtcggtacgatttcgattgaaaaatcagaagcactgtcagaagcactaaaacaagctggtattccgcataaagtattgaatgccaaattccacgcacaagaagcggaaatcgttgctgatgcaggttacccaggggctgttactattgccacgaatatggctggtcgtggtacggatattgtgcttggtggcaactggaaagctgaaattgcaaaattagaaaacccaacccaagagcaaattaacgagatcaaagccaaatggcaagagcgtcacgacattgtaatgcaagcgggtggtttacacattattggtacagaacgccacgaatctcgccgtatcgacaaccagttgcgtggtcgttcaggtcgtcaaggtgacccaggttcatcacgtttctacctatcattagatgatgcgttaatgcgtatttatctcaacgaaggtaagcttaatatgatgcgtaaagcctttactgaagaaggcgaagtaatggaatcgaaattgctgactaaagtgattgcttcagctcaagcaaaagtagaagcacacaactttgacggacgtaaacagcttctacaatacgatgatgtcgcaaacgaacaacgtaaagcaatttacgagcaacgtaactacttacttgaaacggacgatatttcagtgatgatcaacactgtgcgtgaagatgtgtttaatgcggtcattgaccagtatattccaccacaatcgatcgaagaaatgtgggacgttccggcattagaaaaccgcttgaaacaagagtttggtatggaactgccgattgtaaaatggcttgaagcagaagatgatttacacgaagaaaccttgcgtgaacgtatcatcaacattgctaaagagcagtatcaagcgaaggaagcgatggtgggtgcagaagtaatgcgtagttttgaaaaaggtgtgatgctacagaaccttgatgaactttggaaagagcatttatctgcaatggactacttacgcaaagggattcacttacgcggttatgcccaaaaagatccgaagcaagagtataaaaaagagtcctttgcaatgtttaccgatatgctcgaccacttaaaatcaaacgtgatcagcgtattaagccgtatccaagtgcgtagccaagaagaagtagaacaagcagaacgtgaacgacaagctcacgctgaacaagagtcatctcactaccacgcagaaggtgaagagcaggatttcagcaatcttcatatcggacgcaacgagccttgcccttgtggttcaggtaagaaatataagcattgtcacggtagcaaagcgaaatatgcataattagcaagcggtcagataagtaaattattttacagatctgaccgcttggttttatacaaggaattattatgtctaaacctcttattcaagtttcagctggaattatccgcaatgaatttgggcaaatttacttaacacaacgtttagaaggacaagattttgctcagtcgctagaatttcctggcggtaaggtgtcgcaaggtgaaacacctgaggaagcactacgtcgcgaattagaagaagaaatcggtatttatgtgttaagtgcttttccgtatgaacatttcagtttcgagtatccaactaaagtgattgagttttttttctatttggtggaagagtgggtaggtgaaccttttggtcgggaagggcaagagggattttggattgctcaacaagatttagaagaagggcaatttccgcctgcaaataatacattgattaataggctgaaatttgaagccagctactcattagaaaaataataaaaactaacgatatttttctatatgcttaaaaatagcgacaagaaatagtagcattgtcgctattttattgttctatgctatgcaaaatgtcgacctaggacaaaataactttaacatccttacctcagaatcgcagaagctatccgataaacccgatcaaactgttccaacccgtttagacgatgggtaatcatcagcaaggtttttccttgagtatgggataaaatctgttttagtatctgttgctctgtatctctatctaatccttccgttgcttcatcaagtaagagaatatcggcagagctgagtaataggcgtgctaatcctaatcggcgttgttcgccaccagagagtggacgaccgccttcgcctaaccataaatctaagccttgttcttcgagaaggtagcttaaattaacttttgccagcgcttcagataaagcttcgtctgtggcttgtgggttgccaaagcgtaggttttcacgcagggtattgctgaaaatgtggacgcgttggctaagtacggcaatttgttggcgtaatgttttttcagggtaatctttgatattgcaaccatttaagaggatctcgccgcttgtggcatcgtaattacgggtgagtagttggaaaattgttgattttccgctacccgttttacctaatatggcaatgcgttcacctttttttatctcaaatgaaatatggttgagtacttgctcgtgctctggtgaataggaaaaacttacctgattaaagctaataagcggttggttagcctcggtttgtttccattgagctgtgccattaaattggactgtcggttgctgtgcggtaatttcactgatccgttctgccgcttcaatcacttgtcctagatgtaagaatgccattccgatcggcattaagatttcaagggaagcaagcacgcaaaagacaactaaggcgataagagcttcggggttgtctgcctgtggtacattaatggcggccgctgataagtaaatcacggcagtgactaaaatgccgttaataaacattaagagggcatttgacaaaccgcctaactggctttcgtagctttgtgccttgagccattgctgttctgtctgttttagtctgtctgtggcttttgacaatacaccaaatagtaaaaattcgccgttaagttggatccactcgataaactgtgagcggtaggtggctctggattgtatcgcgattttgcctaattttctgcctaaatggtaaaaaagtgtcgggaaaatcagcaataatgcaactaaagtgccacaaattacccacgctaatagaggcgaaacaaaagacaagcctatccccataaacagaataaccataatggcactgataaaaggggaaagtaggtttaaatagagtgtatcaagggtatcaacatctgcaacaaggcggttaagcaactcactgtggcgataacgatttaaccctgctgggctaaggggaataagtttgctaaacaccgcaatacgtaaattagccagtacacgaaatgtggcatcgtgcgtgactaggcgttcaaaataacgagaaatagtgcgaccgatagcaagtcctcttacccctgatgatggataaaagaaattaaagagcaggcttgaaccaactaaagcagacgccgctaaaaaccaccctgataaactgagcaagccgatactcgcagtcagactggtgatcgccaaaataatacctaatgttaaacgcccaaaatgagttttatacagggcaagaaaagggaaaagtgaacgcatagcttattgatttcctaataattctgcaaaaaaccttgtaaggcaagctcggtaaagtttccacgttggataatttgcccttgtttcattacccaaatttcatcagcttcttttaaatcttcaatacgatgggtaatcatcaatgtggtttgttctcggctgagattgtgcaatgcacttagcacctgttgttccgattgcatatcaaggctagcggtaggttcatcaagtaatagcagttgagatcggcgtaataaggctcgagcaatggcaatacgttgagcctgtccgcctgaaagcccgatattgccatcttggatttctcgatctaatcccaaacgatagacaaattcatcagcctttgacaaggcaagagcatttgttaaatcggtttcgttggcgtgttcattacctaatagaatattttctcgtagtgagcctcgcactagctgtggattttgtcctacccacgccaaagtcgcacgccattgagccatatcgagttctcttaactcaatgtcattaattttcacgctaccttgataagataagaaacctagcaacatattcatcaatgaactttttccagcaccactttgccccactaaggcaatatgttgatgagcctgtagttggaaatttagcggttctgttaatgctttgccctgtggcgagaggattacacaatcttgggcgtgaatttcaagcggttggtttggcacttttttttgcccggtggtttgagctaaaaccgtttcacttaaaaaatgctctaggctatccgctgccccgattgcagcggctttatcgtgataataaacccctaattcacgcaatggttgataaaattcaggggctaacatcaaacaaaaaaagccgataaagagggtaacagaagtattgtaagcaccaaaattgagttcacctaaataggtaaaaccaaaatagaccgccattaccgcaatagaaatggcggtaaaaaactctaataccgcagaagaaagaaatgccattttcagcacgtccattgtactttggcgaaattcttcggtacgttggtaaatttgctctgtctgtttgtcggcttgcccaaacaggcggatcgtttctagcccttttaagctatctaaaaactgtccactcaaacgagagagaataccgatatttctttgattagcttcggcagctttaataccagctaacgccataaacaacggcaacagcggcaaggtagcaaatagaattaagccagccgcccagttcaacggaaaaacagccgccaaaatagcaagcggtacgattaaggatagatattgctgtggcaagtagcgagcgtagaaattatggatattttctacttgttctaacattaacgttgcccagcttcctgcagggcgttgttggatcgacattggaccgatgtgagacaacttagccattacttgctcacgcaaatgaatacgcaacatttgcccagctttaaaaccagtccgctctcttaaccaaagcaatatcgctctgcctgcaaagcaagtcagtaataatccaagttgtgacagaaattctgtcggcgaacgatgctcgacaatcatctgatgtaacattgtggcgagtaaacccatttgtgcgattaataacattgcactgaatgagccgaataagacatttaaataaagccacttttttacaattttttgctgttggcgtagccatttttgtaattgtttttgacgttgtttttccacgagtgtccacttatatgtgcgtaaatgatgaaatttcaattaaattactgagattttttcaaaaccctgataatattcttcaagcaatttaaaattacaacaatattgttcaaagttatcttttttattaattgcttttgaataaactttagttgctttctcctttatttttctttgatttattgggttattgataaaaagcatttctttcatcaacaatgaagcatatttatgctcttcttcaaattctttagtaagatctatgtcttcaataacagtatctaaaacaggaaacatattgtttagtttaatacccgcaatagtttttttattatcgaaacccgttgtgattttaataacaaaacgcttatcaaatggtttcttattatttttagtattgggggctgatgataatggagcaaaataagaaatatggttaattgttaatacaacgccaacaaaaatacgtcttttatttttatccaattctttttcgggagaaatacgagtatcaatagagtgtaaaaattttgtatattcaggattaattctgcacaatttgagttgaagttcttgtttcatattgatattcctttataaacacaaaaaggcacttaccgtgcctttttgttttatatcgcactttaatggtagcgttcaccacatatacatcgcactttaatggtagcgttcaccacatatacatcgcactttaatggtagcgttcaccaaatcaggatattaatcctatcgcctttgatggtataaattttctatataaaagtcaatctttatttggcgtgctaatttccattaaaaaactaatcaaattcataccgatacatcaaatctaccgcttgattgatacttgacacccattgcaaatagaggcttggggcaaggcggtagcgtaaggttaattcggtaagaggggcgaaaagtcctacgccatattttactttgaatttcggtgttaaactaccactgacgacgacttttgtgttgtctccaatccctgcggtagtgacattgagatcgttgataccaaaggcactgcccacggtgccaacggttttactgctttttgataaactcattccaattaaggcggcagcaacggaattgcttgaatctgcatcgctaccgccgtctaatcctcgtccagttaaaatgtaggataatgcctgatcctgtgacattgacggggttgagaagattttgacttcgggggcatcagcaattcctgtgactttaacccctgcagttacattagcatcttccattgcttctggattgcggatcgcttcaatgtctagggttggctgggaagacaatccagtaaaggatataagccctttacgaattacgagatcttgtccaaaagaggcaaaggtgccgttttttaaatgaacttgtccatataaacctaatcctcgatttccttgttggactttgataatgccgtttagatctgttttaagaccataggcatctaattttacgtcgttaccaatgttaatagcgacatcagctttgattgccattccgttgttattttgaggcaagtttttattcagtaaagcggtagctttgttcttgttttttgctgatccgtccataatcacttcgtcgctactgatggtgacagcacttttaggtagttcttctacggcaattcttgcccaaggaatatcaatatttccgccaaggattaactcttttggcgtagcttttacttcaatatgtgggctgagatcaactttggcgatattaggaatatcaacacggaagcggttggcctgtgcttttattcgtgtatgccaagcctctagtttttgccaatttgcatcgccttcaagtaatagttggctttctttcgtttgaatattgccttttaaggttgaacttgcacctttaaagtttaaggcaagcattccacctgttacatcaaatggcattgatttagaatgcacttgtagccctgttaagtttaaattgcctagcagttgtggagatagagctgttccacccagtgttaaacgagcgttaatatccccattaactttttcatctgtgctaagtagcggttcgattaaacgtaaatttagctgatctatattgatgttgccagacagtcctcgctgtttggtaagttctttcatcagtagcttgctggttaaacgcccgttattttctatgcgaatatcgctatccaagctcaaattgttttctgcgattttgccatttaatttcaatgatgaaagggacagagggaaactgcgtccgttcagtttttgtgtaaatttaaggctatttgaaagtagctctacattaacttcgggatctttttggctaaaccaagccacatcacctttagcattgacgatacccgttaatatactctctttcggcaagtattcttgtagcatttcaaggttaaattgtttgatttcaaacgacactttcccctctttacccgcactaaatgtttgtgacaagcagagcgctgcttttggatttcgccaacaatgtgcggaaacatctgctttaagttcttgattgtgatagctaacttgtagatttttatcatttttccattcgccaacaggggtatggatattgagattacttagttcaccttgccattgttgtttgctacgatcaaactgccctgctaagtgaagctggatacccacaggctttcctttagcggtcagtttcaggctatgatttgcttcactagcatttgctgtaagattagcattctctagcgttatttcgccgtaagttaattgacgcaagcctatttcgagatcaccttgcacttgttgtgcggtgcttactttccctttggcattgagatgttgtagctgaaattgatcataggctacatgattagcgataagatcgagatctaaactaggttcattgatatttccctgtagcttaatttgtccgttgatattggcttttaagtgtgggattaaaccttgtaaattcggggctttaatggtggcattgaaatcagatttttcgcccaaaacaccttgcattacaatgcggttttcgccataaattaaacttgcttcagggatattgagtaaggtgttatgatctgctgtcaaggtgccttttaactgtaaatgcttttgctgtaagttgccgtgcaaatccatattgtctagcacaaccgcccattcattgcctgtttcacctcgcccaacaaagccttgagaacgaaattcccccgatagtaacgcaacccattcaggaaaaatggatttggtattgacattctgtaaggcaaggttggattgccattctaagccgtttgtccaatcgactttgccactgaatttggtttgcccttgtagtgcgttgagcaatgcttcattgactgcaaaataggttaattccccctgcccttttaggcttaaatctgcagagggaatgttcatacctttggcggataagctaccgtttaagtagtaattgagtagatcgccttttaaagcgaggtcgattttttcaaagacaagcggatctttacctttccctgcgataaaaggatagctgaatttcggacttttaatactgagatcaagcggtgttttaggttccgaaaattgcaaagtactgtgaatatttgcttcaaaagcaccgcttgttttgagatctaattttgcgatgccaaagagttccccagataaaatgagatctgcctgacttgcaggaattgcaagctcttttaaatgtggaatttgagcattgagtttccaatctaaaggataattacctgacaaggtgagtttgccaatccctgaaatagtgcctttgtcgctttgcaggttgagtttttgcaattccactgattgttcgtcagatttcgcttgcaactcaagcaaactgattttgaatagcgatttttcgcttatacctttagcggtcttaactttctgactcaactgcaattgttttgcttgaaattccagcacagagagattaacaggtaattgaataggatctaatttggttaagatcggctgtgcaagctgttgttttaaggcttcccaatctatcggctgagagggagtttcagcgactttttgaggcttttccgtagtttgctgtggtgcaagggaaacagttaaaccttgtaattgagttggggataatgaaaggctcttcccttttccttgaatgcccgattggaaatgctgtaagccaatattaagttcatcaacttgaaccttcacattgtctatgcttatctgttttaacgatacgccaattggaagattaaactcaccgcttgtttgtttggttggtgtggaagggggaagtttgctggtatcaaccgccacttgtgtgtctttgattgcaattttttccacgcaggcggaatatgccaataagcaactcaaatctaaatgtaattccgcttgtccaacttgaacattgaccccgttgagctgatacgcagtatccgtaagcgttaagccattttgtaggcttccctccactttgccaatcgaaagcggatctaaccatttatctgcaagggttaaagcggttctttgccccattcctgttgcaagaaaagctaaaggcaataaaagcaaaatcagtagcacacataaaccacgccataaccaacgccattttgtgttgtggggttttactgctgtatcattgggtgattgtgctaaagattgctctttttccataacattatctcactaaagttctgtgcctaagccaatgtagaattgtagcccttttttattatctggtgagcgtactggcattgccaggtcaaatttaactgccccgataggcgaagcccaacgtacaccaattcctgcccctgaatgtagggttttgctactgaattttttatcggataagcccgtatcgtaaaaggtcgctgcccaccaatctgggtacacttggtactgatactcaacggaacctgttgctaaatgcgatccccctgttagtttaccttggttatttttaggggaaatctttttgtaaccaaaacctcttacgctcatatccccccctgcaaaataacgtaaggaaggtggaatacgttcaaattccgctgattttaaatagccgacctctgctcttgcaacgatacgatgattatcaaaataggttcttacccacgccgttgaagccttaaaactgtaaaaactcacatctgatatgaaggctttatccccaaaattgatggtaactttctggctatccccccataaaggaaaacgtctgccatcagaacgagtgcgatttagagaggctgttgggtagagcaaaaaggtcttaaatttatcactgccctgcctaaaagcatcataacgggttttaaccccgaaggataacgcccagcctgtttcgtggttccagaaacgctgaaaagcagaatatgcccctgtaaattgggtatcgttttgattttctcgatcaagcccacctgacacctgatagtagtaatgaagtggctgtgcttttacaggcattttgtaaccaaactccactctctgtttaggcttagataaatagctatttagctctaaactatgccctcgcccgtttatccaaggctttttccagttaaattgcaaacgaggaccaacatctgtggcatagccaatccccacttcaatatcatttttctttttaggtattaataatatgtctaaatccacctcttttgagggctgctttacacttggttcaactaaaacagatgaaaaccagctacttgaagaaaaatcgttcgatagtatcgataaatcgttcaaataataatagtcaccagacttaatacgcaatatattcgtgagatattcctctcgaatttgattgcctttaaaccctattttgccatagcggtaacgtttcccactatcatagcccaatcgccaatcggcaagatattccttcggatggacttctaaacggtgatacaaccactgcccatcaaaatagccgtttgtttgagagagtttttctatactgcttttaaagttgtcgtaggtttcgtgattaagcacggttcccattggcggaacctctttggctaataaccgtttaaaatcatcgtcttgctcggcttgtccggtgatcttgatttcccgttcatctaatttaactggctgatccaattgtacatatagcgttaagagatctttgttagaagaagtacgaggggttagttcaaagcgatattgagtattgtaatatccctttgctcgtaaggctttatcgacagtttcttgtacaagctgttggtaacgttctgagctgtccgcatcatcgttgcttaactgcgagaggtaaatacgcacattttgatagagacctttatctttgatcccatcaacttcaagtaacactgtttgctctgcattcgctataccaattaaaactaataacgaacaaaaagataatcttgttttcatcgtgttattctacttaaattaatatcagcttattcctgaggtatccctcttaataacggcactgcccgataaggtgctttagaggttaaagcaggttcaatctcaaacaacataataaatggtttaactggttcgacattttccgttttccataaactactcaaactcaccaactgaatatccgcaggtaaatttgcaatcccctgttcaagcacggcgatactgtgcttacgaggatgcccaatcataatcgcaataccgtgtttgcgagcatattgaacggcgtgttgaaattgccgttgtacatcagcaaacacatcactattatctaaaaaaatgtggcgttctaatgcatttaacccataagcttttgctgtttgataagccacactatcccctgcggttttactgtccaaaaaacccaacctttgctgtgataaggctttcatcaagtgttgcattgtcgttttatccgcagtcgctttactacccatatgattattcaaggcaatggcgtaaggtacttgctgttgagcctgatgaattaactcactcacctcgctttcccccattcccaccaataatgccccagcttcaataggctgtttcactttgggttgcataggtaaatggattaagatctctcgtccttgttctttcgctttatttgctcgggctgtggcataaggtgcagaaggaataatggcaacattgacctctttgggtaaggcataaatggcattatcttcttttattcgatagccaatatcatcaataacgatcaccaatttattcgcataagcaagcggtgcaaaaagcccgaaaatttgcaaaagcaacaaaataatagaccgcttgtttatccatttgttcattttactgtacccatttcaaaggattgatcgccacacctttacggcgaatttcaaaatagagagctgaacgactttgaccgccagagtttcctacactcgcaatcacctgccctgcttgaactcgctcacctttacgcacattgactgattgattatagccatacaacgacatatcgcctttaccgtgttcaatcacgactacctccccataaccttgcaaccaagttgctaaaatcactcgtccaccagctattgctctgactggtgtgcctgcacttgcttgaattaccacgccgttccatttaatttcacccatctgtgttgagccaaagcgattgatgattttcccagaaacaggcatacgatatttcccagataagccattacctgcccgaacttgctgtttttcagattccgttgcgctacgacgttcttccttattctttttctgttcaagtttcgcaatatcttgtttttcttgctgttcagactcattgcttgcttgtaccaactgatttcgcaacgcctcttcattcgctttcagattttctaaatgaccttgatcttgagctaaacttttatcaatagaacgcaatgtactttcacgttcatttttgactttctgcaaatctttctcttgcttcttctgtttattaagttgcgtctgttgccctttttgttgctcttttaactcatctcggcgagctttaagatccgcttgtgtgcgacgtaactcatagatcgcatcaatcctcacttgattgatatgctcataataagcccccattcgatctgcatttttggcttcttcggataacaatctctccaatactgaggggtgaatacccgaacgataggcagaatccaattgttccttaagcttctctttttgtaccgcttcctgcttttctaaccgcttgatctcttgttctgtacgtttaatcgatgcccttgtttcagacaaagtcatttctgtttgttttaaactattaaggactttccccatttcaatttcttgattttttaatgtcgattgcaaactatcacgttttttcttttgctcatcaattttgttttttaatgcctgacttttctgctgaattttagacaaatcaccagccatcgtttctgtaaacagcgttggaacagcatacactaaaacaatcagagcaaaatatttaattaatttcaaaagagatccttaattcagattaatataatgactagtggtatatctcaaccgcagatataccacttattctcactacaattttccttccatctgtgatttcactcgagcaacttcctcatctcgcaacacacggcgtaaaatcttacctacattgcttttcggtagctcatcacggaattcaatctctcgaggaattttatagcctgttaaatgttggcgacagtgattacgcagttcctcacgagttaggctttcatcttttttagtcacaaagaccttaatactttcacccgatacttcacttggaataccaaccacaaccacttcattcactttcggatgtaatgctacgacatcttcgatctcattaggatacacattaaaaccagatacaataatcatatcttttttacgatcaacaatgcgtaaattgaggtcttgtcccagctcaacaatatcacctgttgccatccagccatcttttagcacttctgcggtatcttcagggcgttgccaataaccttgcattacttgagggccttttacccataactcgccacgctcacctatcggtaaatcattaccagcatcatcaacaatacgaatgtcggtatttggtactggcacaccaatagatcccgaatactccgtagaatcgttacgtgttgccgcaatcaatggggaacattcggtcataccataaccttcaataatatggcaccccgttgtcttatgccaacgatccgccaccgcacgctgaattgctgcaccaccgcctacagagagcttcaagttagaaaaatcaacttctttcagttgaggattattcagtaacgcattaaacaaagtatttacccctgtaatcgccatcacaggatacttcttcaactctttcacaaaagctggaatatcacgagggttagtaattaacaaccccgttacacctagttcgataaataataaacaattcactgtcaaagcaaaaacgtgatagagcggcagagcaattaccccaattcgctcttggcttcgttggattaaaggataggctacccatttcgcttgaagaatattggcaatcacattgctatgacttagcattgcccctttagccactcctgttgtcccgcctgtatattgaagaaacgccagatcatttttatagagcgttggtcttacatattgacgctgtttcccgatacttaatgtctcacggaaactgaccgcatgtggcaatttatatttaggcaccaattttttcacatacttcacaacaaagttgactagcgtacgcttaccaaaagagagctgatcgcccatacgggtcaaaataacgtgcttcacctgcgtattgaacaccactttttccaaggttgccgcaaaatttgacacgacgacaatcgctttagctccactatcattcaattgatactctaattcacgcggtgtataaagcggattgacattcaccaccactaaccctgcacgcaacgcaccaaacaacgcaatcggatattgcaacaaattcggtatcatcaacgcaatgcgttcacctttctcaaggcgtaattcattttgcaaatatgcagcaaaagcacggctacgctcttccaatttacgaaatgtaagtacctgacccatattaatataagcaggaatatcagggtggcgttgtaccgccttttcaaacatctccaccaacgactcgtaaggctccacatctaaggtacgttcagcctctgctggataattatcaaaccaaattttttccattacatctcctttaaactttacccaaaaatacaggaataaactgagcctgagatttttgagcaatagctcttttaatcataaaaaaagtcactgccgtagtacacaacaccccagcagccacccataattcatggttaagccattgcgataaaaccaacgtcgataacacaatcacaaataatggcaccgcatataaccaaaaaacaccttctaacaaacttctctcggctaacccaattttcactttatcaccgacttgcaaaggcatctcaaccgctaaatcaaattgcggtgcaaatttttcccccgccaatgcagaaagggcttttgaaccacaatggctttgagctacacaaccgccacaactagattttgcttggcattgcactctagcaattccattttgatactgaataacagtggcttgttcaatcatcattgttcttcaccttgtgaactaaactcaatctcttgtacaatatggcgtgccgatgccaacggaatttcgcccacaataatcacatctttatccccgattgtctggctataaacactggtttttccctcacgccaaaactgatcttgaaatgaaatccccttattttgcacaagatataccgtaaaagagaacagaccatcactgtataatcgactttcaatctgctcatcttgagccagcatctcagacaaattttgttgccccgaagccacctgcttaaatccacgaggtacccattttagttgccattctaaaggttttagttccgaatgtattttagtttgcaacagcgttggaagaattaatgtacgaatcggttccacaatgtacaataattgatcacctaccacagattgaattgtcctaaattgctctaacacattattatctcgatccaacaagtggctttgcagcaacagatgattttcctcatcgatccacaacatatattgataacggaaatcatcccttggcacaatccgaattacccttgcaatacgatctgccaaacgacttttgccattatctaaaaacgcatagccctcaagctgagaaaaattactataaacaacggttgggaaatcatctaaaatatggggtgtttttaaactgaacggctgataatcaccaaaatacccaaccacatcttcccttaaaatcatctcttctcttgtggcatcaagatgtagtagttgagcgtactcttgtccgttatcataggcgtgtcgatagcgtaaagaggttacatcatcgcctttttgaaaaatgtaaagctgttcataatttaaggtttgatgagctttattcattgcagtcaaataagctaatggtgtggataatggctgagcaaatcctgttatggataaaaataaactaacaaataaggtaatatactttttcataaaacacctacaccatttttcacaagcggtaatattctgccgctttttagcattattacatttgcggaaaagtacgaaatatattaccaaatataatactaaaattgtaatagtatgattattactatgaaccccatgtcccaacattctcaacgcccatatcaatgaagattaaaacggcatagattcttgacacatcatatccctgcatcttgcaagcagagttttacggcacagagctgataaaaaatcctcttttacaccaaaagaggattttcctagtacaatgaattatttcttcgtcggacgttgccaaccttgaatatggcgttgtggcacacgggtaataaccagttcatcagccgccacatctttggtgatggttgaaccagccccaatggttgcaccgcttgcgacagtcacaggggcaactaactgagtatcagatccgacaaacacattatcaccaatgatagttttaaatttattagctccatcatagttacaagtaatagtgccagcgccaatattcacatttgcaccaatttcactgtcgccaatataggttaaatgccccacttttgaaccttcgccaatggtagattttttgatttccacaaagttaccaacgtgagcttttgctgccagctctgtacctggacgcaaacgtgcgaatggaccaacatcagcactttcgccgatcacactatcttctaagacagaataaggcttaatctcaacattatcacctagcacaacatttttcagcacactgccagccccaattttaacgttattgcctaactggatagagccttctaaaatcacattcacatcaataaccacatctttaccgtgcgttaccgtacctcgcaaatcaaaacgagcaggatcaatgatcgtcacaccagccaataacaatttttccgcttgtattttttggtaataacgctccagagcagcaagttgcaagcggttatttgccccttcaacttccattaaatttgttgcttgaacagcttcaactttgtaaccatcacgatttgccattgcaatcacatcagtaatgtaatactcgccttgagcattgttattatctaattgcgataaccattttttgaaactagcgccacttgcaaccattacccctgtattaatctcttggatctttaattgctcagggttagcatctttttgttccacaatcgcaactacggaaccattttcacggataatacgaccgtagcccgttgggttatccaataccactgttaataacgcaatcccattttcaggtttagctgcaatcaatttctctaaagttgtcgcagtaatcaaaggggcatcgccataaagcattaaaatgttttcatcatcggcaaaaaatggagcagcctgttgcattgcgtgtcctgtgcctaattgctccgcttgtaaaacccaatttactggctctgcagataagcgttgttgtaataaatcaccgccgtgaccataaattaagtgaatttgttttgccgacagctgttttgctgtatcaatcacgtgttttaccatcggttttcctgcaatcgggtgcaagacttttggtaaatctgaatacatacgagtgcctttacccgctgctaaaatcacaacgcttagttgagtcatattaactccttaattaaaataactagaggatactgaaaacttttacattactaaaaccattctctttcaaataaagcgcttgcaacttgctcatcacaccacgctggcaatagagcagataggttttcgattgatctaagttgccgaaatgattagagagtttatagaacggtaactctttgacttcaaccccttcaaggctgaacggtttttcgtccacttcttcagggctacgaatatctaagatcacatcgttttcgcctaattcagaagtagtttcaacggacactacttctttttcggtctgttgagcgatctcacgaatatctaaataatgggcgttttgtaccgcttgttcgagaacgtcaaagttgaaattcccttcttcttcgataattttactttcaatcgcttttactgttggattttttgaaatcacgccacaaaattccggcatagatttggcaatatcatctgtgccaatctcttttgccattgcgataatttgctctttatcgtgggtaatcaacggacgtaacactaaagtatcggaagtcttgtcgattaagcgtaagttcgtcaaggtttggcttgatacttgccctaatgcttcgcccgtgacaattgcttgaatatcaaaacgttcagcaattttgctggcagcacgcaccatcatacgttttagtaccacgcccatctgtccgttatcgactttttctaaaatttcaccgaccacattttcaaagttgatcgccacaaaacggactttatgggacgagctgtaacggctccaaatatggtacgccatctgtttcacaccgatttcgtgcgccgcaccgccaagattgaagaagcaataatgcacacgagaaccacggcgaattagcatataacttgatacgcctgagtcaaaaccgccagaaatcagcgatagcacatcttcctgtgtaccaatcggataaccgcctaaaccttcgtggcgagctttgatgagcaacatcttatcgtggtcaatatcaatacgcaccgtcacatcagggttagtcaatttcacacttgccgactcgatatgctgatttaagccgccgcccacataacgttccacatcaagcgagcggaaatcgtgcttacctttacggcgaacacgcacgcagaaggttttaccctctaattccccttttactttcgcaagggtatgctcaaaaatgtcatgtattgtggtaaacggcatttcttctacttcaagaatatgatgaataccaggagtgcgtttgagtaaacccaatacgagaggagcttcttcagcgacttttgctcgcacttcaataaaatcccagttgcgaattactgccacattttctgtttcacgcagtaacacattacggatattggaggttaaaattttgataaagcgtttacgcacggaatcgcttttaatcataatttcagggaaaagtttgataataaatttcataacttacaatatttgtacctactttaaataatacttgcctattaattatttcagcattactacctctacctaatcacacatcacataagatgatcgaggaaagtaatgttatattccatagacataattaagcactataccaaacacttatttgttaattaacgataagaactctttgcgagtatctctgtcttgcaagaacacaccaccgaatgcagacgtcattgtttggctatgcgtatctttaacaccacgacatttcacacagaaatgggttgctttcacataaaccgccacatcttctgtttctaaaatggtttgaaatgcggttaaaatctgttcggtaaaacgttcttgaacctgtggacgttgcgcaaaaaactgcacaacacggttaatttttgataatccaataacccaatcttttgggtaatacgccacggccactttaccatcaattgtcacaaagtggtgttcacaggtgctggttagggtaatatcgtccaccaaaaccatctcgctcactttcatctggtttttgattttggtgatttttggaaaggtttcataatctaaaccgctaaagatttcgtccacatacattttcgctaaacgatgcggcgtttcttctaaactgtcgtcgcgtaaatccaaacctaataattcaaggacagcacgcatatgttgctggatttcattacgacgagaatctttatctttctgatggcaaaccgttggggtttcaatcccttttgcaagaagtgcatcacgcacactttgggcttctggagagatgttgctcattgatgttcctctaaaaatttaagcgaaagattctaccaaattgccttaaaaatacaacgcaatccacaaaaatcgtgtagaatcattcgcaattacatcaaaaagagaataataaaatatgtattaccattttaatactcaacttgtcgccgatgaaaaacaatcttttgtgcagcaattactagattgcaaagatttcagtcaatccaaccgcttgttaggttcatcaaaagggcgtggtacaacttggtttctcaacaccgaaaaagaactcggtgtaaatagtgtgcttcgtcattattatcgtggtgggttatttggcaagtttgtcaaagatcgttatttttttcaaagctatgaaaaaacacgagcaatgcaagaatttcgtttgcttgcccagctctctcaatggcaaattccagtgcctcggccgattgcaattagagtgaaacgtcaatgttgtttctatcaagcggatattttgttagaaaaaattgcagatacccaagatctgagccaatatctacaaacaaagagcttaacaccagcacaatatcagcagattgggcaactgattcgcctgctacacgatcatcaagttcatcactcagatctcaacattcataatattttgatcgacaatcaaggaatattttggctgattgattttgataaatgccaaatccagcaagggaatgaatggaagcaaggcaatttggatcggctattgcgatcttttaataaagagaaaggaagattatctatccatttttacccacaagactgggaaatcctataccagagctatatgaacaactaaaacactcactttgacgtcccccatacccaaaaggacagggacgtcaacatagttctcccaaataagacttccccttgcaaacgctagacgttttccatacttaaaaaccaaaataatattgaaaaattgcgtaaaactcaccgcttgtaaatcacttttatgctactattcccaccaattttattttttaagatgtaactccaatggcaaccaaatcaaaatatcaagataaacaaattgaagcactattaaacgatcttattgtaacccttgaaaaacacaaagccccagtcgatctctcgttaatggctttggggaatatggtaacgaacattttagtcaccaacgtgcaaagcccacagcaacgtgaagtgcttgctgaggcatttagctctgccttaaaaaactcattaaaatcggcgaaataatatgttaaatcaacttcgccaccttcttcctgaaaattctcggcaatatcgagaagagatctcacaacgtattagttggggtcactggtttgcgttatttaatatcgttgtggcgttgctgatttcctctcgctatgcctttaatgccgactggccaaacacccttttcggcaagctctatttttttattagcttatttgggcattttagctttgtcgtctttgcactatatctgctgttgctctttcctctgagctttctgattaaaaataaccgagctttccgtagtatttcagtgatatttgccactgtcggaatgacgatcctattagttgataccgaagtctttaagcgtttttacctccatttgtcaccgcttgtttgggatctattagtcaatcctaacgacgacggcgaactgacacgccaatggcaattgccttttgtgccaatgccactcattttattagcagaaatgctttactctcgttggtgttggaataagctccgtagtttcaatcgtcagaagtggggaaaatatgttgcaatactgtttctaacttgcttcacagctacccatttactctatgcgtgggcggatatgaccctatatcgcccgattaccgcccaaaaagcaaactatccgctttcctacccaatgactgcgcgtagtttccttgaaaaacacggacttatcgaccgagcagtattagaacagcagatcgaagaaagcggtcggttagacaccttttatctcaactacccacgcaaagccttgcaatttgttgaaccacagcataagcctaatgtacttttcattaatctctctggcttaaaaaatgaagcgattaccgcagaaacaatgccatcgctttaccaagtcagccaaaatgctcgccgtttcacccaacattacaacagcagtgatagtctaagcggtagcgtcgttggactattttacggattaagtggacgctatttagacgcaattttgaacgaaaaagccccttcgctactgatcgctcgtttacaacagctaaactaccaatttgggctattttcacacaacggctttgcagaaccgatttaccacagagccttatttacccatttcaaattacctaaaacaaaaagcaatcttgaagccattgagaaatggaaaaactggatcggcaaacgtagcgacaacgcattttttagctatctagatctacaacttccttcaggcatagactatgcccaacaaagcaaaagtttagattggcaattcaatgaaatttggcaaacccttgaacaacaaggcttaacccaaagtactttaattgtgattacctctgatattgctgaacaagcggtcactagcgacaacagttttgcacaagctcggatccaagtaccaatgcttatctactggcaaggtgataaccgcacctatagcttaccttctagccatttagacatagctccaacactgttaagccagttcttcggggtaacatcgccaattagcgattatgcacaaggtattgatttaacgaaagaaaatagccgaaaatggcttctagcctcaaactataaatggaatgtagcgataatgccaaatggcgagcaatttcatattaaccgtaaaggcgattttgaacattttgatctacaaggcgaaaaacagactagccgtccgccactcgccctgtttttacaacttattcaacaaagtaatctatttattgaaaaataaatcaaagggctaagtatcgtattccaccagacttagccctctacctttatctatgtctttctacccacttgccatcaaggtaatccacaatccatttggttgccttgccgtttttctcagaggtcacatactgacgtttttctttacggctaaagcggataatggcttcattgccttcagggtcttgttgtggtgcgtctgcaaggtattgcagtttttcaggcaaacgatcacggtataaggctaattctgccactttcggagcgcgtgtttcacgggatttcgggaagttgtgtgccgacataaacacaccacttgcgccatctcgtagcacaaaataagcgtccgatttttcgcattttaactcagggaatgccactggttcttctcgtgggggggcgacttcgccatttttgagaattttgcgagtgttgtcacagttggtacagcccatatatttgccgaaacgcccaagttttaagtgcatatccgaaccgcatttgtcacattcgacaatcgggccgtcatagcctttaattttgaaagagccttcttcaatcacatagccgtcgcagttcgggttattaccgcaaatatgaattttacgttgtggatcgatcacatagctatccattgccgtatcacatttcgggcaacgtttgcgtttcattaatgcattagtttccgaatcttcgtctaacacattcagcaattccgcctctggaattaagttgatcgtggttttgcaacgctctttgggtgacaaagcatagcctgtacagcctaagaacacaccagtacttgcggtgcggatcgccatttggcgttggcaagtcgggcagtgaatgtctgttgccactagattattcgaacgcattccgccttccagttcatcaagctctgcagtggttaatttttctgagaaatcggcaaagaagcggtttaattcgactttccagttgctattgcccgacgcaatttggtcgagagtatcttccatatttgctgtaaaatcgtagttcattaaatcgctaaaggcttcgtttaagcgatctgtcacgatttcacccattttctctgcatagaaacggcggttttctactcgcacatagccacgctcttgaatggttgagataattgccgcataggttgatggacgaccgatcccacgtttttccaactctttcaccaacgccgcttcgctataacgtgctggcggtttggtaaagtgttggctaggttcaacggcgttcagtttcaaggtttcattcaaactgacttctggcaactcttgatcttccgctgttttgccttgaattggcagtacttttgtccaaccgtcaaaacgtaatacacgccctttggttttgagttcgtaatcccctgctgttaccattaaactggttgagtcatattccgctggagtcatttggcaagcaaggaattgtcgccaaatcaggtcatataggcgttctgcatctttttccataccgcttagatcttgcattttcaccatcacatcagacggacgaatggcttcgtgagcctcttgcgctttctctttgctggcataaaaattcggtttttcaggtaaataacactcaccaaattgtttttcgatatagctacgagccatcgtcaatgcatcttggctcaagttagttgagtcggtacgcatataggtgatgtagccagcttcatatagacgctgtgccaacatcatcgttttcttcacgctaaaacctaaacgggtacttgccgtttgttgtaaagtggaagtgataaacggcgctttcgctctcgatgaagtcggctttttatcaatttcagtgacgataaatgcagaattttgcaaagattttaccgcttgttctgcttctttttggtttttcgctgagaattttttgcctttatgctgtacaagttctaaagccagatcgccttttttcgcagacgttttagctaaaatatcccaaaactcttcaggctggaacgccttgatttcacgttcacgctcaaccaataatttcaccgccacagactgcacacgcccagccgataagccacgagccacttttttccagagcaacggcgacaccataaagcccaccacacgatctaagaaacgacgtgtttgttgagcatttactctatccatattgagctgttcaggcttttcaaaggcttgtttgatcgcatttttagtaatttcattgaacaccacacggctaaaacgctcgttctcaccgccaatcacctcacgcaaatgccacgcaatcgcctccccttctctatccaagtcggtggcgagatagatatgatcggcttttttagcaagggatttcagctctgaaaccactttttctttacctggtaaaatttggtaagttgcgttccaatcgtgataaggatccacgcccatacgcttcactaaagcggtacgttctttctctgattttactaaggctttttgttctgccgtcatacctttagtcgaaaccgctttggctttttcggttttttcttctttttccgcaccgcttgttggtaaatcacggatatgcccgacacttgatttcaccacaaagtcactgcctagatatttattaattgttttagctttagctggcgactcgacaattactaatgattttcccattgagaatacctaaattaaataataatataaataatattgaaattatttcttaaaagtaaatattaaaattgaattgcatcaaaatttttgtaacaatagcaagcatttccctaaaagacaatatcaagctaacatctatggataaactcaaggcaataaacctattttgtaaagtcattgaaacccaaagttttacccaagcggcacaacaagagcagatttctcttgcaatggcgagtaaactggttgctcaattagaagaacacctcaatgtccgcttattgcaacgcaccacacgccgtatcagcccaacggaagcaggtttgcttttttatcaacgctgccagcccattttaaacgaactcaaagacgctgaagcctgtgtaacgaacattacctcaacactacaagggaagctcacaatgtcgttgccgatggattttggctctcgttttgttgctccacatttacaccgttttaccgaaacctatccacatctgcaactgaatttggaatttagcgaccgtcgtgttgatgtcgtggctgagggttatgatcttgttttgcgtatcggtaagctcgaagatagttctatcgtggcaaaacggatcgcacaagcacaacatctgatcgtggcttcccctcgctattttgaaaaatttggcacgccacaaaccgcttgggaattacagcaacatcaatgtttgctctatgaaagccaaactttatggcaatttaatgaaaacggtcatcaaattaaattaaaaccccaaagccaagtttatagcaacaatggctatgcgttggtgcaaatggcaaaagctggacacgggatcattaatatccctaaatttttacttaaagatgagcttgcctctggtgaactgataccgattttgcctcatcttgaacaagagttatcagatattagtttactctacccaaatcgccgttatctttcccctaaagttaaggtgacgattgaattttttagtcagcttatgcaagaacagaaaatacacctctaacagacttaaccagcaccatcctattaaaaatcacacaaagaatcaaaggctgccatcaatacacttgaaggcagcctttattattaatatttactcagatatttaatatcttaccactgtaatgcaatacctgcaccagcattgtatttgccttgcgaagttgcacctgcagaaactttaagaatcacacgaccattatcagacattcttgagaatccaacagcaactgcattttgtccctcgaaagtaccaataccagcacccaatgtgctttacctggtaaagtcacttgtggaatattgctcatagccgttgttgcagcaatacccgcacgaagttgacgcccttctctctctaacttcgcacccaatctatgtgcaacattatacaactggctaccattaatcgcatcggtactttgctcagagattaaaccaggtgcaacgttttgaatacggcgagtttccattgtaccatcgctgtttacattacccacgctcaccacgcctttcacttcagttgctttaccgccggcataagcgttatacacaccacctattacttggtattctaaagcacccgctcccgcagtggttgcacctgctgccacatagcctgagtttgttcccaagaataccgagttgctggttgtattggtaatcttgttacccaatgcaaagacattttcgttctcaatcgtattattgttacccacagaataagagttatcagcattaatcacacttgggtcaccaaatgcaccggagttattgccgttcactacgttacccgtaccgatagagatagattggttgcccacagccttagcattatcaccaatagctatcgatttttcgcctgaagcaattgcaacgttaccaatagccaccgattgtatgccagctaatgtactgttaccaaatgcgaccgctctatcccctttcgcgtgagctttgtaaccaactgcagtagagtatgaacctgaagctcttgaatccactgtattcgacttatggttaatttgctcctctgcattatgaccatcattggtgtggatgaacctgatacgattggttaaaacataaacttgacgaccattcactgcatcagtactattcggtgaaatatcaccatcagcaataccactcagtttcacacgaggatcaactttctctttatatttctggagattgccattctcatcacgaataggttgtttagtcactgggtcccatttaacaaactcttcctcgactttctctcctgcaccagtaaggttgattgtattcttatcaccagtcattgtcgcagtgcctaaagtcacagaatttaagttcgttaaatccttgttcattttcacaacaagtttgttatctgcctcttgcgcttccacataaaggttattagccgctgagtccttaccattccatttgccttcaccctcaacggttaacttcgtacccaatggacgatgtacagtggtatcggcgttgttacccgtcaagtctaagcccgcttgtgcaatggcttgtaagtcttttactgtcgctacattatttaacgcatcacccgtttgagccaataagccgcctttaccgtctttgttatcaccagcaatagctttttgtgcatctgcaggggtaagtgccgttttatttgattcagcatcatctttcaaacctaaaccacttcccacattttctccttttggaccagcaggccccattggacccgcagggccttgtggtcccgttggacccgcaggccccgttggacccgtaggtccttgtggtcctgctggacccgttggacccgcaggccccgttggacccgtaggtccttgtggtcctgctggacccgttggacccgcagggccttgtgatcccgttggactcgcaggtccttgtggtcccgttggacccgtaggtccttgtggtcccgttggacccgtaggtccttgtggtcctgctggacccgtatcacctttgtcacccttagcccctgctggacccgcaggtcctggaagaccttgttcacctttaggacccggttcacccttaggtcccgctggacccgcagggccagtttcacccttaggtccctctggacccgcagggccagtttcacctttctctcccctagcacctggagctccatcatttccttttggaccttgtatgccctgagcacccgctggacctgccggacccctcggacctgttggaccagcttcgccttttggtcctggatcaccattatcgcccttaggtccttttggaccttgtggtcctgttgctccagcaggacccgctggacctgcaggaccagttttaccttgtggtccagctggacctactggacctactggacccgcagggccagtttcgccacgatctcctttttcacctttcttgataatgtcatgcgaactatctgtatagataatttttagaccatcatttgtttcttccgtacgttcaattaacttacccatagcggcaatcctatcaattttatttttgagttcgtcctctaatctaaccgtaatcgtactgccattagcagaggaagtaataccattttctccttttacagtgagcgtaccactccaaatgcctaccttgccactgccgttatcgcctcctatttgcatggtgagcgatttaagctgtgccacgtttaccgcatcggtatcttgtgtaccagccgcaacgttggtgatttggcgtttgatggttgtaccacccacagaaactgcaccaatattattaccatcaaccttttgtgtggatttaaagccgttagcttcagtgcttgttcccgttgtgacagaatgattttgttttaacccctctacaccgccagctgtacttgcattagaaccataacctaatgccacaccgccacccacggtgacaacggtattatgaccaagtgcggttgctccagcagcactaccatttgttttggctctttcacccacagcaacagagctcctaccaccagcagaggccatataacccaaggcagtagcatgactttcagcacttgctaggcttccaactgccactaagttttgacctgtcacaccgatatgggcacccacaacaacagaagatgcccctgctgttgtcgcagacttacctatcgcaatggaatctgtcccaacacctttcgagttccaaccaagagcaacggcgtagtttccagtagcagttgcactaccaccaaccgcaataccgtactcattggtagacttactattcgcaccgatagcaatgccttcatctttacttgcagatgctaaaggacctaaaacaatagatccttcgcccttagccaaagaaccacccccaatagcaatagaggctccaccactcgcagttgttatttttgtttttttggattcgtcttgggattgggattggggttggggttggccttgggctgtatcctcaggttgatatctcgttgtttttaaatcatctccaccgattgatatggagccatacccatccgctttggcatttgccccgataacaatagattttgccttacttgcagtagcagagtgacctattacaactgcttgttcaatatttgccgcactggcttgtctgcctaagacaacagatccctttcccgcttttgaagcactcccgatagcaactgcttcagtctcatttactacagtattgttgcctatcgcaatagagttgttcttttctcctgcatttgcatcataacctatcgcaatattatgcctaccttcagcttttgacttctgaccgatagcaatagcaccatacgaagccttactctctttaccaataccaatagtaccgttgtcatatcctttactcgatttattagcaccatcttgaagatatggtgttgcggtatttgttgcgttagcagcagctgatggactaaaaaatatacctagtaatactagacttaaaagacttaatttaaatttatcttgctgtttatctaaaaaataatctgaggtgcatacttgagctcttttatccgtgtaagcggatgttttggtgtgagactttactaactcagacacaaccacccaagcctgttgagcatgactccaaataactctaaatattttattcataataaccttctctactgtttttcctaataaaaaatcataaacctttatttacattttcaggatgcacaaatacccccatcgccctcgctttcgctcgggcacttcccccgcaagcgggggaagttaactccttgacaaaccatatattagatggattgaatattgtagggtgggttttaacccaccaataaaatcaatatgttacggctacatggtgggtcaagacccaccctacaagctgtttttcctaataaaacatcgtaaacctttatttacattttcaggatgcacaaatgtccccgcacgctattgtaaaaaaaaaaaaaaaacaaatgagtaacacaaaactaaagataaaataacaagaatttttcaacttttatcaataaaagttagaaataataggcggaaatctaataagtgctaaaatcatttagacaatatattgattctgaatggatttttattgatagcagtgtcatcaaggctcaccagcatgcaacaggtgcaagcggtcaaaatccgcaagcgattggcaaaagtgtggcaggtaatagcacaaaaattcatttagcagtagatagttgtggaaatcctattgattttgttctgacggggggctttgaatttacataaactgacacttttttccactcttaaaggataccagtaatgtcatttatctaaggtaagaagctgtgggtaaattaaaaggcgggtgagctgaataatcgactatttttattcgatcactaaaacgctgataatgcagcacatattcagacgttctatcgccaaaaggtttacttaaatcaaaggcaagaataccaatgtgataatgccatagatgattttctcgcgcatattttactttttgagcaaagtgcggatcgtttttatgcacgttgtcggaagatttattcctgccttcaaggttggtaaagccaaaattttgaatatgctcaacgaattcaacgatcgcatcttggtcttttactggaaaattggcaaattctttacgaaaaagtgagccatattcaattgtcaagttagccattaagtaaccactccttaattgcttttgcacttgttaagtccgaaggcatttcaatagtttcactttcaacgtgtgctttcattctttctagatcgtagttaaatgcaggctcttccaccttatcggcaatttgtttttctacgttttgaacgtaagaaattagtgcttgtttttccattcctgattgaattgcttgcacaatacacgccatttgttgatgaaagtaatccgattgaatataaatttgagccatattacctccaatgctgaatagggttgcatttattctaacagaaatttttgttggaagaataaaaaataacggcataacgagaaatcattatgccgttaaatttgtaggggcaaatgacatttgccctaatatcaatagattaaatcgaacgtttaatctcaaccacttcgaatacctcgatttggtcgccgacttttacatcattgtagtttttcacgccgataccacattccataccgttacggacttctgaaacgtcgtctttgaaacgacggagagattctaactcgccttcaaaaattacgacgttatcacgtaatacacggattgggttgttacgtttgacgataccttcagtgaccatacaacctgcaattgcaccgaatttcgggtgacggaagacatcacgcacttctgccaagccgatgatttcttgtttaaattcaggttgtaacataccgctcattgctgctttgatttcgtttaatagctcataaatgattgaataataacgtaaatcaatgttttcgctttcgataatgcgacgtgctgaggcatctgcacggacgttaaagccaagtacaatagcgttagacgctgccgctaaggttgcatcggtttccgtaataccacctacgccagagccaaccactttcacttttacttctgccgttgaaagctcgtgtaaagattgaacaatcgcttctacagagccttgtacgtctgctttcacaatcacgttcaattctgcaacatcgccttccgccatattgctaaacatattttcaagtttcgctttttgttggcgagccaatttcacatcacggaatttaccttgacggtataacgccacttcacgcgcttttttctcatcacgcaccactgtcgcttcatcacctgcggctggtacgcctgaaagtcctaatacttccacaggaattgatggaccagctgattcaatgtctttaccattttcatcacgcattgcacgaacacggccatattcaaagccacaaagtacgatgtcgcctttgtttaacgtacctgattgaacaaggatagttgcaactggaccacgacctttatcgaggtaagattcgataaccacaccgcttgccataccctctttcactgcacttaattctaatacttccgattgaagaagaatggcttcaagtaagtcgtcaatccccattccttttttcgctgaaacaggaacaaattgaacatcaccaccgaatttctcagaaatcacttcgtgttgtaataactcttgttctacacgctctaggtttgcttctggtttatcaattttgtttaccgcaaccacaatcggcgcaccagctgctttcgcgtgttggattgcttcaatggtttgtggcattacgccatcgtcagctgctactacaagaacaacgatatccgttgctttcgcaccacgcgcacgcattgaggtaaatgccgcgtgtcctggtgtatctaagaaggtaatcatcttaccgtcgtcggtttcaacgtgatatgcaccgatatgctgagtaataccgccagcttcacctgctgctactttcgctttacggatatagtctaataatgaggttttaccgtggtcaacgtgtcccataatggtcacaactggcgctcgggttactttttctgcgtgtaagtcacgatcttctaagatcgcttcttctaactcattttctttacgcagaataactttgtgtcccatttcctctgcaacaagctgtgcagtttcttggtcaatcacttggttaatggtcaccatttcgcccattttcatcattgttttgatgatttcggtcgcttttactgccattttgttcgcaagttctgccacagtaatagtttcaccgatcaccacatcacgcgtaactgcttgagctggcttagtgaaggcttgttgtaatgcactgcctttcttcgcgtgtttacccttgcctttggtatctttttggttacggcggtcagattgacgttcatttttactgccgttttcatcatcacgtccgccttttttggttttcgctacaccgcctttgccacgtccacgattgccttcactacgacgctcagagtcacgttctgcttctaacgcatatttagaagtaaagcggtcatcttcatagtcttcgccattttcaatcgcttcttcacgggcaatttctgctaaacgacgagcattttctgctgcacgttttgcgtccatttccgctttttggcgagccacttcttcttgcttacgacgcaattcagcttcttctttacgttttgcctctttttcaggatcaaccgctttttcttgttttggttgagcttctgcttttggttgcgctggttttggttgtttatttggcattacaggcacttgatgtaccgttttttttgcttcttcggctttggcagcttctgcttttttagcctcttctttcgctttagcttccgcttcttgtttcgatttcagtgcttcttcttgggcttttttagctgcttcagtatccactttgcgagatttacgcacttccacttgcacttcttttgctttaccgcctgcagtcgtaccgctcacggttgttttagtacgacgctgtaaacttaatttcttcggtgcgtctgttttgatttcattttcactcattctttctctccctgtttttagctaaaccagcaaatttgacgagcagccataattaattctgcggctttttctgcggttaattcttcaatatcagctaaatcatcaacactttgctctgcaaggtcttcaagagtagtaatctgtttttctgctaatttaaaggcgatatggcgatccataccttcaagatttaacaatttatcttcaatatgtgcctgttttaatgcttcttcttccgctaacgctttagctgtgatcgcatttttagcacgtgcttgaagttctccaactagatcttcatcttctaagccatcaattgctgtcagttccttaactggtacataagcgatttcttctaatgaggtaaagccttcttcaattaaaagatgagcaaattcttcatcaatttctaaagcgtccataaagagattaatcactttattgtcttctgcttgatgttttttttctaactcatcggttgtcatcacatttaatgtccaacctgttaattgggtggctaaacgtacattttgaccattacgaccgatagcttgtgcaagcgcgtttgcttcaacagcaatatccattgagtgattgtcttcatcaacaacgattgagctaacatcagcaggtgccattgcgttaatcaaaaattgtgctgggttgtcgtcccacaacacgatatctacacgctcaccgccaagttcgttagtaattgcctgtacacgcgcaccacgcataccgacgcaagcacctactggatcgatacgtttatcattgcttttcacggcaattttggcgcgagagcctggatcacgagaagcccctttgatttcaatcacttcttcaccgatttcaggtacttcaagtttgaataactcttgtaacatcactggttttgcacgagtaacgaatagttgaggaccttttgactcgggcttaattgcataaagtacaccacgcactcggtcacctgggcggaagttttcacgcggtaacatatcttcacgcacaatcactgcttcagctttagtggtatcgtcctttttacctgcaagctcaagaataatactttcacgacttactttttttacagtaccgataacaattttgccttcttctgaacggaattgttcaatcactttattacgttccgcttcacgaattttcatggtgatcacttggcgagcggtttgcattgttatacggtcgaatgcgatagactcaatctcatcttcaacatagtcacctaattgaatgttcgggtcttcaaattgagccgcttctaaagtaatttcacgagtgtggtgatgcactttttctaccactaaccaacggcggtaagtagtaaatgctcctgttttacggtcaatcactacacgcacatcaatatcaatgccgttgcccgttttacgatcttcacgttctgcagccgctttctttttcgttgaaatggctaatgcggtttcaagtgcctcaaaaatggcatcttttggtaataatttttcattggataccgcttctgcggctaataaaatctctttactcattggttttgatttccttagaaattaaaaacggggattaaatttgctttttgaatgttgccaaaggcaaaagcctgtaaattgccatcaacttttaaggtaattaaatcaccttcaacactcactaattcaccttgccatttacggcgatctaacattggaatgcgtaaatgaacaacaatttcacgcccaacaaagcgttgatagtgggctaatgtaaataatggacgatctaacccaggggaagatacttctaggttatatttatccgcaatcggatcttccacatcaaaaatcgcactcacttgacggctaacatcgctacaatcatcaaccgtaacaccgccttctttatcaatatataagcgtacagttaaaaaacgacctgcacgttggcactcaacgccgacaagttcaaatcccattgcatcaatgggatcggcgacaagctcttgtaatttttgttctaatgttgccaaggaaacctccatttgacagatataaaaaaaggacttgaaaaagtccctttaacacaacaaagctgactatgtagccacaaaaaagcctcaaactacaacagttgaggcttcaagcggtttgttttatctaacattttacaatttcaaatgcctagatagaacaaaactcatcgtcttaaccaaaacaatgagccttaaaactggttgcgggagccggatttgaaccgacgaccttcgggttatgagcccgacgagctaccaagctgctccaccccgcctctgatgtggtgcattataggggataaaaaaatccgtgcaactcttttttttagaaattaagaatgaatgctagatttttagtcaaaatatgcttaagcattatctttcaacaaaaacacccctttatttttatttctatataacaatttctttgggattcatcataatcttctgggttaaggttaatcattaatgttttcccttgccaaagtgcggtaatttcccaatggtttcccatatagacagcctgcctaatttcacaatattgagctgcagttccatcacttaacaagcggatactttctggtcgtaatccgacaagacaatccccatcaggtacttgaaaacgtgctgcattttcaagggtaaaagaaaactcaccgatattaatttgattgccttgtcgttttcctgaaaaaatggttgattcccccataaaatgagcaacaaagagagagtttggctgtaaatagagatttttagccgtatctttttgcataatggtaccctgatccatcacaattacttcatcagacactgcaaaggcttcactttggtcatgagtaacatagagcgaagtaatattgagccgttgttgtaactcacggattttttctcgcattgaacggcgtaaattcgcatctagactacttagaggttcatcaaataagagaactttaggcttgagaattaacgctcttgctaatgccactcgttgttgctgtccgcctgaaatttgatcgacatagcgatcttcaaaccctatcagatcgactaactctaatgcttcttttactcgctgttttcgctcttctttggatacaccctgcatttttagcccatattccacattttcaccaatcgacatatgtgggaaaagtgcgtaagactgaaatacgatacaaatatctcgctgttgcgttgcgttgtgggtaacatcttcgccgtcaataaaaatttgtcctgctgtggggctttctaaacctgcaactaaacgtaacacagtggttttgccacagccagaagggccgagtaacgtgaccattgtgccttgtttaattgaaaagtttaagttatctataaccctatgtttaccaaaagatttgctgatatttttcaacacgagaaaatcatttttttgttccatttttccctccaaattcatctttttgctttgaacgggctatatgcgtatcgccaacaagccaatcaaataagaaaatcattgccagcataactacaatcaacattgagccataggcaatcgccattccatattccccatcctctactcgatttaaaatatatgaggttgcgacgcgtgtgtctgctgtaactaaaaagatgatcgcactgactgttgtcattgatctaacaaaactagtaactaaggcagaaagtaacgccggttttagcagtggcaatgcaacaaagcagatggtttttaatgatcctgctttcagcgagagcgaggcttcatctaaggctttatctaactgtcttaacccagcgatagccgctctcattcctactggcatattccgcatcaccatagacaaaataataataagccctgttcctgtcaggtaaataggttgatggttaaaagccagaatataggataccccagccactgttcctggtacggcaaaacaaagtaacgtcagaaattctaagggctttttccctttaaaatcacggcgaacagtaatataagcaatcaacaaaccaaaaatagccgtaatcggtgctgcactagcggcaaaaatcaccgtttggattaaagatggccacgctccactattaaacccttgtccaaaaagattgaggtagttattgaatgtcagtgtgtggtctattccccaacttacggtaaagctaccgtaaaaaatactaccgtatagtacaaagttaaacagaacccaaaaacctaaagtgcaaataattgcccatttcataccgcttggtaatgcttgtacatcacatcgataagatttacctgatacagtgatataagatcgattgccaatccagagatattgcaccacaaaaatcgtaagggaaaagagtaacaagatcacacctaaggtgcttgccgaagcataatctaactgtgaaccagcaatatagaaatagatttgagtggcaataacgtcaaaacttccacctaaaaccaaaggagtgctaaagtctgcaagcgattggatcaccacaactaaaaacgagttggctaacgctggcttgagtaatggaaaaataatatagaagaaggcttgatagcggttagatcgtaaagtataagcggcttcctcaacagatgggtgaatagattttaatgcaccgtctaaaatcataaaagacattggggtcagtgcgagggtatgggcaatcactatccctgtaaaaccataaagccagttattactaaagccaagataatcgactaaaaaagcagtcacatagcccgaacgtcctaacataagggtgacacctaagccaacaacaaatggcggtgttacaatgggtaagatagagaaaattttaccaataaacgccgtgcgttttgcaatccgtgtggtataaagagcaaaggctaaaccaaacaacgtagataaaatcccaacagttgtcgcaacacttaatgaattaccaatcactcttaatacataaggctgttgtaagatagacaacacttgacttggtacaaattcactgccgtcgtaaaacattgagatgaaaattgccagtgttggatagaccataaagaaaaagatcaacaaaataatgctaatcaatgaggcaataataaatctgtcaccctgcattatttttaattcagcaagggcatttgtcgctaacgcaatcaacgcaacaattaagaaaaaaaccgcataacctaagctgatttttgctaaaattgcggaaagaaagataaagagaaacagcccaactgtcccgaataactcacatttacttcgtaatgttgagggtgttttgttcggatacagataaaacagtaggggaaaaaaccatatccaagtaaggttaatatcattccaccccatagcctgttgaaattcagctgaagttgcttcaaacagtccatattgcaatgcttttaccgggaaaaagcaaaagcctaaaaaagcaaaaataacccaagtcaatgaatgacgaaaaaaaaatgtttgcataaccctctataacatctattccacaatctttcatcattctactattaaacaaaatgatagaatagttaaattataattcagcgccaactaaagaataatcaacccgatcttcaaaaaaagatcgggtttgagtgtcatactttaagaacgcccagcaaaaaaagcgaatcgttctaaaatagaaccattctagctcaaaaaaaacaatcaagtttccaaataaaaaatattagctgagaaatagtagaccagctaaaaagataacaaggaatttacccctccaaactcttccgtcaatttttctgtaaacagacgtaattcttccgtcattaacagaaaatccgcatcgaaacgttgggctttgtcttctttcaaaatatcatcgttcttttcacgcacttcatcggcaaatttgacacgggcaagagtggcatcttcgttcaacacaaaagaaaaatgattttcccaatctaacgcaagttttgtgacaaatttgcccgcttgtaaatgttggctaatttcgtcgctttctaaatcttggcgtttacaacggattacgctgtcggtatcaaaagattttaattctgcttcttccagaagtgtcagccagcttggtgtatgcccttttgccacccaatttgtcatcacttcgctcggctgtagcgtgaaggaaatcggcacaacaggcagagagccaagggatttgcgtaataaagcaagggtgtcttcggcacgttttaccgagctactatctacataaacgagctgtttatctaagtctaaccaaatcgccgtaaattggtgtttactaaacgcacgaggcaacaacattgccacaacatcatctttgatcgcctgcttttccgtttttttcagcttacgttgctctttttgttctaaggtttcaatgcgattttccgtttcttttttgacgacgtgagctggcaataatttttcttctttatgagaaaccagtaggaactgctgaccctgtgcaaagtgcaacagttcacttcctgcaagcggtgacgaccagccaaatttttgcatatcgctttgttggcaaggggtgaattttgtttgctgtaattgtgcgtctaattcactgctagtgaagcgtaattcactggttaaacggtaaatcattacatttttgaaccaatatgtcataacatctctctttatctaaaattcattatcaatcaataagttactgaaagttcatcattgattactttgattatatcaccataactcaaaatgatagtaaccattttgagcacgaatatcacaatcacttagtcttggtatagaagtatagtaggaaactttccaagctcaaattactataaacgtgacaaaacattttcttgcttaaaacacaaaatgtaaattttgtgatctttctctcattttcgaatattttcgattgtttttgtttttaaggggtgtaaacttactttcgaaagcaatcgtagtatgtagtggttgttttgatgtaggagagaaaatgaaaagtagcgtagaaagacgttctgacattttggcattattgcaaaaaacaggcagtcatcgagttgaagcattgtctcagcatttcggggtttcgacggttactatccgttcagatctcaatgtgttagagcaacagggctatattacaagatcgcacggttttgcggtattaaattccagattaatggcggaactttctattgcggataaacgcaataattatcccgaactcaaacaacagattggtcatctagctgcctctttactaaaagagggtgaaaaggtgattttggattctggaacgacaacgaaagcaatcgtaagtgctattggcgatcttaacttgacagtattgacaaatggacttgatgtcgcaatggcattggtttcttgtccaaatgttgaagtaagaatgacgggtggggttttacggaaaaatgcgatgtcgttttcgggagtaatggcggataataatttgcaacattatcgctttgataaagtctttttgggtgttgatggttttgacttacaaaaaggggtcacaacctttaacgagcaagaggctcagctaaatcgcttaatgtgcgatgcagcggatcaggtgattgtggtgactgattcaagcaaatttggtcaatatagccattttgttatttgccaagccaatcaaatagatgtgttagtcacggataataaaattcctctaagttatcgagagtatctcgaaaatgtcggggtgcaagtgttaattgcgtagttttattctctttccttataaataaatccatttatttgtgagggaaatgcaatgatcctcaatattgctaaccaaacattagaaaagcagaacgctttttggacggcaaaggaaattgcccaacagccagcgacttggcgtgaaacggtttctattgtgaaatcgtcacttgttattccatttcttcagcctcttgttgaatatgcaaaacaaggcgaacttcgtgttatttttacgggggcaggtacttctgcttttattggtgaggttgttgcaccgatattaagccagcatttaggttgtgctgtcgaagcgattgcaagtactgatcttgtatccaatccttatcaatatctttttgcggataaaccaacgcttttagtctcttttgctcgctctggtaatagccctgaaagtattggggcagtagagcttgtcgatgaaattgtagagaaagcgtatcatttagccataacgaataatgtcaatggggcattatttaaaaaatgtgagcaagatccgaccgcttacccattagcattaccagaatcaacccacgatagaggctttgcaatgacctccagtgccagcaatatgatgttagcggcattagtggcatttttacccgatgtatttgatgatagctgggttgaggaaacggtatcggtgacagaacagttactagaacgggatctgctcgaaatccaacgtttagcccatctgccattaaaacggatcgtctatttaggcagtgggcatttccaagggcttgcccgtgaaacttctttaaaactacttgaactcaccgctggtgaacgtcttggcttctttgagtcgtcaatgggcttccgccacggaccaaaatcccttgttcaagatgaaacgctcatttttatcttcttatctcagcaaccttataccgcacaatatgaccgtgacctgtatcaagagttaatcagagataaaaaagccagagaagtggtgttactaggcgatacaagcggttcgatccaggctgaaattcacaaattagatgacgcagcacggattttcccattcttagtgattgggcaactttactcgttttatagctcgctctatctcggctacaccacggataacccttgtccgacaggcgaggttaatcgtgtggtgcaaggtgtaacgatttatccatattgatatacaggaggcaaaaatggcaattttaaatgtacgcattgatggacgtttaatccacggtcaagtggcaaacttatggacgtcttatctcaatatcactcgcattatggtcgtcgatgaagtcgcggcaaataatgacattgataaagcaggcttacgcttggcttgcccagcaggggtgaatttaagtgttttacctgtggaaaaagcagcagccaacattaacgaagggcgttatgactctcaacgtgtgttgttggtgacaagaaccccacaaacgatcttacagcttgtggaggcaggcgtaaatctgccagaagtaaatgcagggaatatgcctaaaacggatctaacacgtcctatccgaaaaacagtacacgttactgaagatgatgtggaagtgtttagaaaactttctgaaaaaggcgtgaagctcaccgctcagttagtgcctaatgaagaaaaagtcgatttaatgaaacttttatagaggagtaacgattatgatcgaatggtggcaaatacttttgataacgctctatgcgttctatcaaatcctagatgaaatcacgattgtatctagtgctggttcacctgtgtttgcaggctttatcacaggtttaattatgggcgatttgacaactggattgttaatcggtggttcaatgcaattaaccattttaggtgtaggtaccttcggtggtgcatctcgtattgatgcaaactcaggtactgttatcgcaactgcattctctgttgcagctggaatggatccacaattagccttaacaaccttagctgtaccaatcgcagcgttaatggtttataccgatattttagcgagaatgtctaacgtattcttcgctcaccgtatcgacaaaaatatccaagaccacgcttatagtgcaatcacggtaaactatctctgcggtgcaatcgcttggggtctatctcgtgcattaccaatcttcttagcgttagtgtttggtggtccatttgtggcaagcctagcagaagcaatgcaaacaggcttcttaaaagttatcgcagatggtttaacccttgcaggtggcgtattaccagcgttaggtttcgcaatcttacttcgttacttaccaacaaaacgtcacattgcatacttaatccttgcattctcactcacagcaatcttcattactctcttcggtaacatcaatgctgtaggtgcatcaacaggtgtaagcaactcaatcagcagcgtaccaatgcttgcaatggcagcaatcggatttgcattcgcctacattgtttaccaacgtagcgtagaaggtggctcagccccagttgcaaaacaaaataccacttctgacaaaggagaaattgaagatgacgaactctaatcaacaagtcggaaatccaaaaggctataaattaacagatgcggacttccgccaaatcaatatccgtaacttattcttcaaccaagttggttggaactacgaacgtatgcaaggttcaggttatttatggattatgttgccacagctacgcaaaatgtacggcgacaatacacctgaactacaaaaaatgatggtgatgcacaaccaattcttcaacaccagcccattctttaacactattgttaaaggtatcgacttggcacttgaagaaaaacaaggggtgaaatcacttgaagccgttgcaggtatcaaatcaggtttaatgggaccatttgccgctatcggtgatgccctattcggctcacttgtcccagcaattatgggggcgattgccgcaacaatggctgtgaacggcaatccgcttggtgtcggcttatgggttgcggtagcgattgcaacaatggtattccgctgggtgcaactcaaaatcgcttatcgtgaaggggtaaacttagtcaccaacctaagtcaccgtttgaatgcactaaccaacgccgcaacagtgcttggggtattcgttgtgggggtaatgtgtgccacgatggtgaatgtcaaagtaccgtttgttgccactatcggtgagaaagtcgtttccgcccaagcgaacttagaccttatcttaccaagattagtccctgcgttagtggtgttcttcatctactggttactcggcagaccgaaaatgaactctaacaaagcgattatgatcatcatcgcactctgtatcttgctctcttgggctggattgttggcgaaagggtaatttaaaagggacacgaggcgtcgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgctaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtatgcgtaaactgctaaccattatgaatgcgttggttagacgcaatgaaaaatgggacgctacacgctacttatccacagaatctgtgggtcaaaattgaataacttttttgtgtgtaaacacagttgctacaataccatcgaatgtagcgacgccacgctcggcgccctaaaacaagcggtcaaattcattcaaaatgttacaaataactaagatctaaaacccaatcactctttcctagatttattcggttttatatctttcaagcgaggtgaactatgcctttccaaatcggcgaaaaggatttcctactcaacggaaaaccgttcaaaattctgtcaggtgcagtacattattttcgtatcgtaccagaatactggtacaaaacgctctataacttaaaggcaatggggtgtaacacggtggaaacctatgtgccgtggaacttacatcagccacagcctgatcaatttaacttcagcaagcgggcggatttagtcaaatttttgcaaacggcaaaagatttagggctgtacgttattcttcgcccaacaccttatatctgtgcggaatgggagtttggcggattgcctgcgtggttgcttaatattccaaatatccgcttacgccaaaacgatccgctgtttatcgctgaaatcgaccgctatttccaagaactgcttccacgcattgccccttatcaaatcacccaaggcggtaatatcctaatgatgcaaatcgaaaacgaatacggctcgttcggcaatgataaaaactacttgcgagctattcgggcgttgatgttaattcacggagtgaacgtaccgcttttcacgtcagacggtgcgtggcagaacgccttagaagcaggggcgttgatcgaagatgatattttgccgacgggcaactttggctctcgctctaatgaaaatttagatgagttacaatgctatatcgacaagcacggcaaatcttacccgttgatgtgtatggaattttgggacggctggtttaaccgttggaaagagcctgtgatccgccgtgatgctcaagatttagcggactgcaccaaagagctacttgaacgggcgagtatcaatttctatatgttccaaggtggaacgaattttggcttttggaacggctgttccgcacggttagataccgatttaccgcaagtaaccagctacgactatgatgcccctgttcacgaatggggtgaaccgtcagagaaattctacctgctacaaaaagtgttagggcagtaccctgatgccagcccgattgtcgatccgattttgccaaatatcactgcttacccaccgcttgcagtgcaaaatgaagtgtcgctgtttggtactttagacacaatcagcgaatgctacgaaagtccgttcactcaaacaatggaacagctagggcattactacggttatctgctttatcgagccaaaccgatggcatacagcggtgagatcaagctgagaatttaccaaggcagagatcgtatccagattttcaacgataaacaaaaagtcgccacccagtaccaacacgagatcggcaatgaagtgatgttacagacacccaatggcgagttccaacttgatctgttagtggaaaatatgggacgggttaattacggcggtaagctacttgcaccgacacaacataaagggatcggtgctggggcagtgcttgatctgcatttccacacaggctggcaacagtatgcgattgattttgaccgcttggaagagattgattttgatggcgaaaaagatagccaagccccgtcgttctatcaatttaagttacacctagaccaagaaccgcaagatacctttattgatacccgtgcgttcggcaagggggtgattgtggtaaatggtgagaacttagggcgttactggaatgaaggcccgacttgttatctctatctgcctgcaccgttactgcacaaaggcgagaatgagattatcgtctttgaaacggaaggggtgaagatcgatagcttaacatttagcgataagccgatttataaagagttgaatacgaagaacttataaggacaacccaaaaaatatcgtcaaacttccccctttgaaaaagggggattgagggggatttaaagatctaaacagttaatcgcactatcttaaaatcccccctagcccccctttttcaaaggggggaataaaaaattcaaaactaccaaaaggagcaactatgagcttaattttaatcagtcacggagagtttgcggaaggcttactggatactgccgaaatgattttaggcaaaatcgacaatgctcaaaccgtctgcttatatccacacgaaggcagtgaagatttccaagtgaaatttgagcaagcattggcgaatgccagcggtgagattgtggttttttgcgacattatgggcggtacgccgtgtaatgtggcaatgcgttacttgccgaaattatcagggttatatagcggaatgaatttaccgatggtgattagctatgtgagtgaagatggcacggacggcttactggaaaatgccaaagaacaaattcacgatgtggctcaacaacttaaaaacttagcgttaggcgatgatgaataggagtagtagtatgtctaaacaagatttaatgaaaaaactttgcaccaaagagggcattattgctgctcttgcgattgaccaacgtggtgcgttacgccgaatgatgggcgatgatattaccgctcagcaggtcagcgaatttaaaactttgatttctcaagaattaactccctatgcgtcgtcgatcttgcttgatccagaatttggctgggcggcttcagagaaacgtgatgcaaattgcggattaattatggcatacgaaaaaacaggctacgataaaagtattgccggacattttcctgatttgatcaatgatgcttctgttcatcgcttaaaagaaaaaggcacacaagcggttaaattattgatctattttgacattgatgaaccgcacgaaatcaacgaccgcaaagccgcttttgttgaacgtgtggcttctgagtgtaatgcagaacaaattccgctgttcttagagatcttgacctacgacggttcaaacgaagataaagtctataacgccaaagtcaaacctcgcaaagtaatcgaagcgatgaagttctttgcggataaacgttttggggtagatgtcttgaaagtggaagcgcctgtggtgatgagttatgtggaaggctttactgacggtgaggtgctttacagtcaagcacaagcggcggaattctttaaagagcaaagcgaagcaacggatctgccgtttattttcctaagtgcaggcgtttcagccaaactgttccaacaaacccttgaatttgctcaccaagcaggcagccggtttaacggcgtactgtgcggacgtgcaacttgggctggtggtgcggaagcctacaaagccgaaggtgttgaagccgctcgccagtggcttaaaagacaaggtaaacagaatatcagtgagttgctcgaagtgttagaacgcacggcaacgccgattaagtaaaaaagtaaattgccccttttgagtatagaaaggggcaatctattttaaacgtgaggtttacattcaggtagtgtaccttcaatttcaaagagtacatcaccatctttaaagaagacatagcccccatttttcatttttgtccagttctcattttttgtgagaggctgggttgtaataatggtgactttatcactttcttccgtatattcacggaaatcaatcattacatcatcatcacgcaatgccgtgccgaatggggctttgcgacagatataatgtaagtttgttgagcaacgtgcgatcatccagtgcccattggaaagaataaaattaaatacgccgtgtttagcgatttcactggcaaaatctacaattgcgtcaaaaatctctttttcacttggtttttgtggaaaacgttgttttaagctggcaactatacagcaaaatgcggcttcagagtccgttgagcctataggctgatagtgattattcgggcaaactttgacatcaaccgtgccgttgtgggcgaatacccagttttcaccccaaatttcgcggataaatgggtgggtattttctaaattgacatcgccacaggttgctttacggatatgggcgataacgttaaaggatttaattcgatattgactgacgagatctgccattggtgatgaggcacctgggcgattgtctctaaaaatacgcacacctttgccttcaaaaaaggcaatgccgaagccgtcggtatggtggtcggttaagcctgcacgccgtcgaaatccttcaaacgagaaagtaatatcggtcggcgtattacaattcattcctaataattgacacataatttacttctttatttacttcaaaaaaatataaaaatcccaccgcttgttatcattaacaagcggtgggatttaagcgaaatttgacaaaaaattcaataggaaaattatattttattgatcttaattcgcctcttttttaattaatgagagtaaaaagagtgttcctgcacaaacaaccactgaaggtcctgctggtgtatctttgagggcagagagtaataatccgccactgaccgataatatgcttaatccgatggcgtaaataaccattgtttcaggggttttggcaaagcgtcttgcggttgcagaggggataatcagtagtgaggtgatgattaaagccccgacaaatttcatacttaatgcaatggttaatgcggtgagcaacattaataagaggcgtaggcgtgcgacatttaggccttcaatttgagctaattcagggctgactgtgatggcgagtagctttttccaatacagagccagtagtgtcgcaatgccgataaccccgatgctgataaagagtacgtcgttaaaaccaattgcaagaagatcaccaaataggtaggacattaaatcaacacgaacattgtctaatagactgatggtgataacgcctaaggataaactgcaatgagcgataatgcctaatagggtatcgactgagtgagtagagtgttgttctaaccagacgaggcaaagggcgagtatgacggtcattagaataacagcaatatagggatcgatttgtaggaaaattcctaatgcaaccccaagtaatgcggagtgagagagggtatcaccaaaatatgccatttttcgccagacgacaaaagctccaagcggtgcggtgatgaaggttaaaaatacgcctgctaaccacgcaggaaataaaatctcaaacatattgcctcaattagtgatgtccgttacaacgacatacattgccttgtaagtcgtgatggtgattatggtgatgagaataaaatgccacgtttttcgcaaattgatcgccaaagaagtggataaaacttgggtcacttgaaattttttcaggtgtaccagcacagcagatatggcgattaacgcatagtacttcgtccgtatttgccattacaatgtttaaatcgtgagaaaccattaaaatagcacagtttaaccattcacgagttttatttaatagttgatagagttccgtttgccctgtaatatccaccccttgcattggttcatctaagacaagcagttgtggacggtctaaaattgcacgggcaagcagtactcgttgtaactcaccgccagataatttttgcatactatgcttagcaaggtgagtgattgaaaatagggacaatgcttcatctatcaagggtttagtgctgttaggcttgagagatagaaatttttcaacggtaataggaatagagtgatccagatgcaatttttgtggcacatagccaatttttagctgtggttggtgaataacctgccctgatgttgctggctgtaatttcagcaatacttttaatagggtagatttaccccccccattaggaccaacgatagttgtgatagaattggggtagatgtttaaatgaatattttcaagggcaacttgtgtaccaaaattcacattaatcgctttcagttgcacaaggggcttcgttaaattgtggatcggcttaatttgcttgatctgcataacattaataaatttaaggatttaaggaattaaaattagcggatttttttcagttttacaagaaatctatgggaattttttgcctattcctttgtctataacaagttcgcactagaagaaaattatttaggatagaattttgcaacacgttatttttgctagagatcgccgtcgtaagaagaatagagtaaaggcatttgtgtttttggtgattatattatctatctttatcggtatcgctttaaccttaaaaagaccgagttcaaattcttcagaaacgcaagaaattccgattgcattggcgacccagtcgttacctgaagtcaatcaagagagtgaaaaactcgctgttcctactcaaacagaacaagcggttggatctgtccctgaagtttctactgctttatttcatggtgaacctaagtacatcaatattgacttcactgcctcggctaaagaggaacaggaacaagtaaatgctgagcctgttgatgaaaatgcaacctcttatgaagatgaattgagtgatgttgatgatgaaatagaagggcaacctaaagcagctgttcctgaaagtgaaaaattatcggaagaagcagaaaatgtattagaagatgtgttagatattgcagatcaagcattacgtatccaaaatcagtttagttataccgtaactcaaggcgatcagctaaaagatgtactagaacagtcaggattaacacatgccacagcaaaagccttagaaaaaacctttccacagttagccgatcttaaagtaggacaacaattctactggattttagacaataacggtgagctagaatatatgaactggctcatctcagaaaaagaagagaaaatttttgagcgtaaagctcaagatcaatttgcggtacaaacaattcagaaaaaaggcgtttggcaacaagatgtgattaaaggcaccattaatggcagttttagtgcaagtttaaaagcggtaggtttatctcaacgtcaaatcaatcagttagctaacggtctgcaatggcagattgccaccaataaattgaaaaaaggcgataaatttgcaattttagtaaagcgtgagtatatcaatggcaaggtcacggatttaggaaatgtcgaagccattcatattatcagtggcaagaaaagctattatgctattcaagcagataatggacgttattataaccgtcacggtgaaacgttaggtaaaggctttgctcgccacccattgccattcacaccaagagtttcatcacattttaatcctcgtcgcttacatccggtaacaagacgagttgcccctcataaaggggtggattttgctgttcgatctggaacaccgattattgcccctgcagatggtgtggttgaacatatcgcttatcaagcaaacggtgctggtcgttatattaaactacgccatggggggcaatatactacggtgtatatgcacttaagccgttcgttagttaaagttgggcaaagtgttaaaaaaggacaacgcattgcgttgtctggaaatacagggcgttcaacaggtgcacatctgcattatgaatttcatatcaatgggcgaccagttaatccaatgacagtaaaattgccgggtataggatctggtatgcccgataaagaacgtaaagcattcttagtgaaagcacggaatattgaaacaaaacttaaactctagaaggatttataatgaaaaaaagtctattgaccctaattagccttgcaatcttaggtacggcacaggcgaatgataaaaacttacagcaacagcttgagaaaattggggcaaccaatgtgaagttgtcagaatctgccttgccaggttttaaaacagcgatttctgatcaaggtgttgtgcaaattagcaatgatggacgctatgtaatacacgggcagatttttgaattaaaagatggcaaaatcacggatattactaatcgtgcattgctctcagaactcaatagtctagcaaaagagatgattgtttatcctgcaaaaaatgaaaaacacgttgtcactgtttttatggatattacctgccattattgccatttattgcactcaaagatcaaagaatataatgatttaggcattactattcgttatttagccttccctcgtggtggtatgaatactgaaactgcaaaacagatggaagcgatttggacagaaaaagatccagcctttgcattaaacgaagcggagaaaggtaacttaccaaaacaggtgaaaacaccaaacattgtgaaaaaacattatgaacttgggattaaatttggggttacgggtacgccaaatattgtcacaaaagaaggtgagttaatcgctggctatgttgagccaaaagagttgctcaaaatgttaagtcactaatccttaatttaaactacaagcggataggttttattctgatatcctccccgcctcaagaggcgggaattcctaagtgtaaattttaaacgtatttaaagacctataatttcatcgtttgaatactgataaaaattgaccatgcattagcttcttgaaagctgccctcccccaatagatttcataattttgtgatctctttcacattttctcttgaaatccccttgacaatcccaatttatagtttcgtcaagcgagagtaatctcgaagtcagaacatttaataacagaatttagaggaaactatgaatattgataaatttaccagcaagtttcaatcagcaattgccgatgcacaatctttagccgttggcaaagataatccctatattgaaccggcccatttaatgcttgccttgttaaagcaaaatgatggatcaatcacaccgcttgtcaccagtttaaatgtgcaacctaaccgtttaagcagtgaacttgatggcatcatcagccgtttgccacaggtgcaagggggcaatacccagccgtcacaacaacttttccgtttgttaaatcaatgcgataagttgtcgcaacagtttggcgatagctttatttcatcagagctgtttgtacttgcggcacttgaagataacggtgatttaggcaagttattgaaaaacttaggtttaaccaaagagaaggtgacagccgccattcaacaaattcgtggaggggagagcgtgaataatcaaaatgcagaagaaacgagacaagcgttacaaaaatatactattgatttaaccgagcgagctaaggcaggcaaacttgatcctgtgattggacgtgatgaagagatccgccgtacggtgcaagtgttgcaacgccgtactaaaaataaccccgtgcttatcggtgaacctggtgtggggaaaacggcgattgtcgaaggtttagcacagcgtatcgttaatggcgaagtgcctgagggtttaaaaaacaaacgtgtgctttccttagatatgggggctttaattgcaggggcaaaataccgtggtgagtttgaagagcgtttgaaagcggtattgaatgagcttgctaaagaagaggggcaagtgatcctgtttattgatgaaattcatacgatggtcggtgcaggtaaaaccgatggagcgatggacgcaggtaacttgttgaaaccgtcccttgctcgtggcgagttgcattgtgtcggggcgacaactttagatgaatatcgtcaatatattgaaaaagatgcagcactggagcgtcgtttccaaaaagtgttggttgatgagccgacggttgaagataccattgcgattttgcgtggtttgaaagaacgttacgaaattcaccaccacgttcaaattacggatcctgcaattgtcgcagctgcaaccctttcgcaccgctatatttccgatcgtcaattgcccgataaagcgattgacttaattgatgaagcagcgtcgagcttgcgtatggaaatcgactctaaaccagagccgttagacaaacttgaacgccgtattattcagttgaaattagagcgtcaagcgttgcaaaaagaagaagacgaagctagccgtcagcgtcttgcaaaattagacgaggatctgaccgctcgtgaacgtgaatatgcggagctggaagaagtatggaaagcagaaaaatccgctctgttaggcacgcaacacattaaaaccgagttggaaaatgcccgaattgaaatggatcaggctcgccgtgagaataactttgagaaaatgtcggagttgcaatacggaaaaatcccagcccttgaaaaacagttacaagaagcggtaaaacgtgaagaagaaggcggtgaaaatcatctacttcgcaccaaagtgaccgatgaagaaattgccgaagtgctttctaaagccacgggtatccctgtatccaaaatgatggaaggggaaaaagagaaactattacgaatggaagaggtgctacataaacgggtcatcggtcaaagtgaagccgttgatgcagtggcaaatgcgatccgtcgtagtcgtgcaggcttgtctgatccaaatcgccctatcggttcattcctattcttaggaccgacaggcgtagggaaaacagagctttgcaaaacattagccaacttcctatttgacgatcaagatgcgatggtgcggatcgatatgtccgaatttatggaaaaacacagcgtatctcgcttagttggcgcacctccaggatatgtcggctatgaagaaggcggatacttaaccgaagcagttcgccgtcgtccatattcggtcgtgttgctcgatgaagtagaaaaagcacacccagatgtattcaacattttattgcaggtgcttgatgatggtcgtttaactgacggacaaggtcgtacggtagatttccgtaatacggtcgtcattatgacatcaaacttaggttcgcatttaattcaagagaatgcggaaaatatgagttacgatgaaatgaaaactatcgtgatgaatgtggttgggcaacatttccgccctgaatttatcaaccgtattgatgaaactgtggtattccacccattagataaagaaaatatccgtgcgattgctagaattcagcttgaacgtttaattaaacgtatggcggagcgtggctatgaggtaacggtgacagatgcggcagttgatcatatcggcgaagcaggctttgacccactctttggagcaagaccgcttaaacgtgcaattcagcaagagcttgaaaacaccttggcacagcaaattctctcaggcaaattgttgccgaatagtcctgtgacagtggattatcaagaaggaagggttgtggcagttcagtaaaagagtaagagcgtagagatacgccctttgttttgtgaaatacattgacttttctatgatttctcgctaatttgtgggcgtttttaacacaaaaactatttatttacaggagattctatgcaagatcgtttagtcacttccacaagaagtgaatcccttcttagcacacataaagtattacgtaatacttatttcttacttgcgttaacgcttgtattttcggcagtggttgcatctgtcacaatgacacttaatttaccacgtttaccttggtggggaatgttagtcggtttttatggcttacttttcttaaccaatgcaacggcaaatagtgcagcagggttagcaagtgtttttgcgttaacgggtttcttaggttatagcttgggtccaattttaaatgcttatatcagcaatggcttaggcgatgtggttgcattggctttaggggcgactgcgttggtattctttagctgttctgcttatgtattaactactaaacgtgatatgtctttcttatcgggtatgatgattgcgttgttcgtggtgttattagtgggtattgtggcaaatatcttcttagcaatgcccgcgttaagtttagcgatcagtgcattatttgtagtgttctcaacggctgcaattttatattcaactagcaacattatccacggcggtgaaacaaactatatccgtgcaaccgttgatttatatgtgtctatctacaacctatttgtgagcttattacagcttttaggagtatttagtagtgatgactaaataaatttagctcattggattcattaaaaatagttataaggggacgctaatttagtccccttaatcatcaatgcgcctcgtcccagttgcctccaaccccaacttctgcaatcaatggcactttaagctcaatcgctttttccatttcagctttaatcagtggggtgtaatgctctactctgtcggctttgacttcaaagactaattcatcgtgtacttgcataatcattgcaatatcttcgcaatttcgcaccgcttgatcgatcccaatcattgccactttgataatatctgccgccgtgccttgcattggggcgttgatggcaacacgttccgccgctttgcgtcgcatttggttgcttgagttgatttcaggcaaatataaacggcgaccaaataacgtttcaacatagcctttttcagcggctttttcacgaatatctaacataaactgttgcaccgctggataacgctggaagtaaagttccatatattttttcgcatcggtacgagaaatgcccagttgatttgccaagccaaattcagacattccgtaaatcaagccgaagttaatcgccttggcactacggcgttgttcactcgtcacagcttccaacggcacgccaaaaatttccgccgccgtagaacggtgaatgtctttaccttcggcaaaggctttgatcatattcgcatcattagcaagatgtgccattatgcgtaactcaatttgcgaatagtccgccgccaaaatcacatagccatcacgggcaataaaggcttgacggatacgtctgccctgctcgttgcggatcggaatattttgtaaattcggatcgcttgatgaaagtcgccctgttgccgtgaccgcttgatgatatgaagtatgcacacgtcctgtttgtgcattaatcatctgcggtagtttatcggtataggtcgatttcagcttgctcaagccacgatgttccatcaacagcacaggcacttggtgtcccatttgagccagttcttccaacacttcttcgttggttgatggcgcacctttcggggttttctttaaaatcggtaagccgagtttgttaaataaaatctcttgcagttgcttagtggaagcaaggttaaacacttctcctgcttcttgatgtacaagggtttcaagctcttttaaacgctgttcaatctcaactgaatgtgccaacagtttggcaggatcgattaatacgccgtttcgttccacacgggaaagtacgctcaccaacggcatttcgatttgctcaaacagtttcaccaattcaggcgttttttgtagttcagaccataagagttgatgtaatttcattgtaatttcggcatcttcccctgcatattctgttgctttatccagttcaatttgatcgaatgtaagctgatgtttgcccttacctgccaactcttcaaaaggaatagtttgatgtcccaaataacgctctgccaaattgtccatattgtgacgaccggtgctgtctagggtgtaagattgcaacatcgtatcaaaggcagccccttgtagctcaatgccgttgcgagcaaaaattgttaaatcgtatttgatattctgcccgattttgcggatatttgggttctctaaaatcggttttaactgtgccaaacagtccgctttgttcaactggttaggcagtaacgcttcgacttcatcgagttctgcttcactttcaccaaacagatccacttgggtcggctgtgtaattttgcctttatgtgccaacggaatgtagcacgcttcgccattttctaaaccaaacgaaatcccgactaaatttgcttgcattgcatctaaattgtctgtttcggtatccaccgccacaagctctgccatttgcaattttgccagccatttggtaaagagttcagggctgttcacgcaatcgtaagcggtgcgatctatctcgacttttgcaaaaggtgcagatttttgttcggcactgaccgcttgtgtggcttgataattgttcgggattttctctgccgatgtttgtgtcactgggttagcatcattcatcacttcgttcagccagcgtttaaattcataacgaccaaagagttctaccagttgatctcgctgttggggttgagtaacaagctgatcgtaagtgacatcaagggcaacatcggttttgattgtcgctaacagataagagagatcggctgtttctttttctgcttccaatttcggtgcaaaggtttttgccccacgaaatgataactctgcaactttgtctaaatttgcataaatcgcttgcattgagccaataccttgcaacaacgcaatcgccgttttctcaccaacaccttttacccctggaatattatcggacgagtcgcccaataaggctaaatagtcgataatcaactcaggcggaatgccatatttttcaatcaccccttcacgatctaacaaggtattgttcatcgtgttaatcagcataatatgatcgttcaccagttgagccatatccttatcgcccgtactgattaaaacgtgcttacctgcttgtgaagcctgcactgcaagcgttccaattacatcatcagcttccaccccttcaatcgacaacagcggaatacccaatgctttaatcattgcgtgcaaaggttggatctgcgaacgaagctcatcgggcatcggcggacggtgggatttatactgttcaaacagctcatcacggaaagttttccctttcgcatcaaacacgacagcaatatggcttggttcaacctgtgcaatcaggctttttaacatattcaacacgccatacatcgcccctgttggctcaccttgtttgttagttaaagggggaaatgcgtggaatgcacgatataaataggacgaaccgtccactaaaacgagcggattttttgcaattgttgccatttgaattctctttgatctaaataatttgggctattatagcgaaagtggggggattaaagaaaaagttttgagaaattatgtctatccatatttttccccaaaacgctccccatacaataggggactttacgatttacatcaaaccattacgattctattaacatcggtaattctgacatactcactaatttataatcagccaaagcccagcgagggtcgtcccattccgatttttcaggaataacaacggttttcatactcgctgctttacctgaaatcatacctaaaaccgaatcttctacggcaaaacaagcagatgttggaacgccaagttgttttgctgcgtgtaaatatacagcggggtgtggcttgttgtactccaattcctcagcagaagctaaataatcaaaatattcagctataccacagctatcaacaatgccttgtagcatatttcttggtgaagccgaagcaactgcgattttaatcccccattgttttaaggtagataaaacatctttcacatttggcattaacggcttcgcttcaagcacctttccaactacatatgccatcaactcttctattaactgagtacggctcttttctttttcgccatatttttgtagcacataatcaacaagcgtaccaactggtgaccctgtaagagtcatcatttcagctaaggttacaggaaattggttttgttgaaaaaattcagtacttgcttgataccaaataggttgggaattaattaacgtaccgtccatatcaaaaattacagcttcgatcattttacattcttccgttattgattattacaagtgcttcccctaaaacaaagcaatcactgtatcctacatgcttttcacctttgaaatataattggcaattcattcctattcagataaatagacagaaactaagttatatccccaatttttccttataatgcaaacggcatacagaaagatagctatcgtttccaccaatttggatttgatctccatcttttaccgcttcgcctttctcattcatacgaataacaaagcctgctttacgcccacaataacagatggttttgagttcttcgagctgatcagcccaagcaagtagatagcgacttccctcaaataattcagattggaaatcggtgcgtaagccgtaacaaagcacagggatttttaatttatcgaccacttcagtcagttgataaacctgttgcttggtaagaaattgtgcttcatcaatcagaatacagtgcaatttttcatcggcaatgtaagcggtgatttcatcaaataaattgctatcgtttttgaataaacgagcatcttgtgaaataccaattcgagaggagactttccctacgccataacgatcatctatcgccgcagtataaacaagggtattcattcctcgttcttgatagttataagatgattgaagcaaagttgtggatttccctgcattcatcgcagagtaataaaaatagagtttagccataataaatgaagtaataaaaaacggctaatcaaaagtattagccgtttattcaaacaaagattaaacgttgtcgatttgacctaacagagagcgtaaacgatcttggaagttttgatgttcagtttttaattgctcgtgttcttgacgcagagtttcatttgcacgattagcttcctcgtttttaccttttaactcttcaacttctaattgaagtaattgaatggtttcaacagcctgtttaattttttcttcaagttggtctaaaattgcgactgacataatatgttcctctagtgagtagtaatgaaagtgtaaagattttaccttacttagaagaaattttcattataaagttcggggttatggataaaaaagcacattgttagacataaactttttgtaactttctcaattaggggtagtatatgtctatcaaaaattagatattagattagtggtaaagtagcttgtagggtgggtcttgacccaccatataatcgtaacatattgattttattgatggattaaaacctaccctacaatatttaacctattaatatatggtttgttagcggtctagtacctagtacggagatgagatgaaatgaaaattgagaagaaaagtaatgaggcaattattgagccaattgaagataattggaattggttagatgaattgggagagccagatcctacgtttaattatcaacatatcaaagaatttaaacctgtaccattattaaactacgaagattggttagctgaagataaaaaaatcccctaacaaattgtcaggggattgcgagattatttcacgcgagaaacatattcgcctgaacgggtatccacacgaataacttcgccgatttgaacgaaaagtggaacacgaacaactgcacctgtgcttaatgtcgcaggtttaccaccagtaccagcagtatcaccttttaagcctggatcggtttcgataacttctaattcaacgaagtttggtggagtaacgccgattgcagagccgttccataatgtgatgatacattctgcttgatcaaccaaccatttgtcgttgtcgcccaatgcttttgcatctacagaaatttgttcgaacgtttctgggtgcataaagtaccagaaatcttcatctttataagagtaagtgtagttgtaatctacaacgtctgctgcttcaacggttgagcctgatttgaagttgatctctaatactttaccagatattaatttacggattttagtacgggtaaatgcttgacctttacctggttttacgaattcgttttcaacgataacgcaaggttcaccatcttggataaattttaaacctggtttgaaatcattagtgctgtaactagccattgtgatcctcagaatttagataaaaagtaacgcccaaagggctaagatataaaaaggcatatataatacactaaaaatggcaggcaaaaaattaaaatttttcttaagtatggcggataaagccgtttcaggtataattcaccttttcaatcaatgaggaaataaaatgaaaaaagcagtgttaatgggcttagttcttgcccttagcgtttcaaccgttcaggcgaaaaaagcaggtggaatgaaattttcttcaagcaaaaaaacacccgcaacggttcagcaatctacaacacaacaaaaagctgatgcggactttaataatacgccaaatcaagcaatgccaaatgctggtgctgctcaacaggcgcagggcaaccggttaggcaattttgtgacaggggcggcggcaggttacttattaagtgaagcactttccccaacggaagcacaggctcaaacaccagcgaccaatccaacagaacaattaaccaaacaggtacaacaagtgccagcggtgccgacctttaaagcgattgatccacaaaacgacccttaccttattgagaaaacactgggttatttgcgttactgcttaaatggtgtgcaatatatggtaggaaccaacaacagccaattaccaccgacattgatggtagataaaaccaacgcaccaatgcagtgtgtgattagccagtaatttcatcagcaaaaggggcaaatttgaacatctcattttacgacgcaccaacgaaagctcaatggctacaagatctggctgaatcctttaatcgaccagaagatttattgcattaccttgagctaaacattgcagattttgagcaagatcttaccgctcgtaaactgtttgcgttaagagtgccacgcccctttgccgaaaaaatgaaaaagggggatcgggcagatcccctttttttacaagcgatcacattacaagaagaatttaccaatgttgatggctttgtccaagacccactggaagaacagcattcgccagcccctaacattttgcataaatatcataaccgcttgttatttatggtaaaaaatagctgtgcgattaactgtcgctactgtttccgccgccactttccctatgatgaagtcaaaagtggcaaagcaacgtggcagaaaagcctcgactatataaaagcacattccgaagtggaagaagtgatcttatcaggaggcgatcccttgatggcaaaagaccacgaaattgactggattttcacccaactagaacagatttcccatatcaacaccgtgcgtattcacagccgtttacctgtggttattcccaaccgtattacagacgaattatgtgaacggctattacaaagtcgtttgaaggtcgtgttagtgacgcacatcaatcacgccaacgaaatagatgacatttttgcggaaaaaatgcagaagctaaaacaaagcaatgtcgtgttgctcaaccaatctgtcttgctcaaagggatcaacgacaacgcccaaaccctcaaagccttgagtgacaaattatttcgctacggcattttaccctattatttgcacctattagacaaagtggcaggggcgagccatttttatattgaagatagcagagcctttgaaatttatcgtgaattgcaacgcattacatcgggttacttagtgccgaaattagcacgagaaatggcgaaagagccgaataagacattgatgggtgtctctgctaattgatattcagttccttaatcgctcaatctctttactaaattcttctatatcatcaaaacttaaataaactgacgcaaatcgaatataagcgactttatctaaggactttaattcacctaacaccaagtccccgacaaatttactcgaaacttccctttcccctgtagcttgaagctgtaacacaatgcggtggatcgcttgctcaacatcgtccgtgctgacggggcgtttttctaatgcacgagataaactggttcttaatttacgttcatcaaaaggttctcggctaccattatttttaacaatatgcggaatgagtaattcggcactttcaaaggttgtaaaacgttctttacagactgggcattctcgtctgcgacgaatttggtatccatctgaggttaaacgtgaatctacaactttagtatcatcagtagcacaaaacggacaacgcattattttaaccctttctgtcttgctacaaattcagcgtgtaagttttcagggggcggaggcatctgcaaatagaacccttcattttggattttttgcaaaacttcttgattatctacccgcttaagctgtttctcacctgctaaattaaacaacattacaaactcaggtttaccaaaaatttgacgaagttctagaggtaccgcctcaaatttatcccgtttttccacataaagatacattccttcttttttagggcttttataaattgcacataacatcttattcgtcctctagtctatagctgccttcgtaattggtgaaacgtgaatattgtccttggaagcctaatggcactcgtccgattggaccattacgctgtttaccaatgatgatctccgccattccttttgtatctggattatcgtgataaacctcatcacgataaataaacataattaaatccgcatcttgttcaatcgatcccgattcgcgtaaatccgagtttacagggcgtttatctgaacgttgttctaaactacggttgagctgagaaagtgccactaccggtacttgtaactctttagctaaggctttcagtgagcgagaaatttccgcaatttcaagggttcggttatccgcaaatccaggagcgcgcattaattgtagatagtccaccataattaaacttaatccaccgttttccttgtacacacgtctcgcgcgtgaacgtaattccgttggggttaaacctgaactatcatcaatataaatattacctctggattgcaacactcccactgtactaccaaccctagacatttcctcatcatctagttgccctgtacgaatacgcgtttgatcgaccgttgaaagcgaagcaaacatacgcatcataatttgatctgctggcatctcaaggctgaaaatcagcacaggcttattcggttgcttaactttattgccattctcatcttcgacctcaacatctcccattgctgcattttcacacaaattcatcgcaaatgttgtttttcccattgatggacgggcagcgacaatgattaaatctgaaggttgaagtcctgctgtttttcggtctaaggcggcaaaacccgttgatacacctgttacaccgctattattttgagaacgagagagtaattctatgcgagctaaggtttccatcaaaatatcatcaatttttttcggcccttcgtcagttgcagttcgcatttctgcaatatgaaaaacggatctctccgcttcatctaatacttctttaactgtcaatcccttagggttatagctgatttctgcgattttattacccgccgcaatcaattcacgacgaatagcccgttcactgacaatctccgcataaactaaaatattcgccgcacttggggtatttttagacagttcagcaagataggcaaaaccacccacatcttgcaatatgcctttattcttaagcacctgatcaagcgtgataatatcaataggctgattattgcgagatagtgaaaccatttcttcaaaaatcagacgatgagcgtgattgtaaaaatcggtactctgaacacgctcagcaacgctgtcccagtactcgttactcagcattatcccacccaataccgcttgctctgcttcaattgagtgaggggcaatgtttatctgttcaatctgtttatctttttgaggatctttatttttttgatattcagccattgatgaaactcttttcagggaaatgataaaaggtagtttaccgaatttgccaaaaattttcagctggtttaccccgtacaaaaatagcgagacacaaaatttgttgataatctgcttcaactacactaatttcattatttaatagtaatcatagaaccaaagttaaagcactgaaaccacagatctacttgtgaaaaacctgcttcttttaggcgtgctttatgtgtatcaatactatctgtccgcatcacattctcaagggctgtacgcttttggcttacttcaagctcactatagccatttgcacgtttaaacgtgtggtgcaaatcaataagaagttcatttattgtgttatcttcaaaagtaaatttttccgataacaccaacacaccatttggatttaacccctgataaattttacgtaaaagagcaagcctgtcttctcttggcaaaaattgcaacgtgaaatttaggacaaccattgatgcatttttaatctcaacgtgacgaatatcatcacataaaatttccacaggaatatccgaatgataggcttccaaatggcgacgaccgcgttctaccataggttcagaattatccacaccaataattcttactcctgctttttccacattacgccgaatcgataaaatcccagccccacgagaacaacctaaatcatagacatttgactgatcagtcacaaaacgagaagcaagcataccaatcgctgtaatgatattagaatagcctggcacagaacgttgaatcatatctggaaaaacttccgcaacagattcatcaaaagtgaaatcccctaatttctcaataggggctgaaaatagagtatctttagacataaacaatattattgatagtaaatggtgtattctactcgcaatttataaagattgtagaaaataatttatttagcaacattcctaatttagtgaatacgtataagtacgatataaaaatgcgcaaatcaggacaaataacatcacaataatttgaattaatctctttttagtcaatttctctgccgccattttcactccaaatctaaataaaccttgttcattattccctaaaaaaatgttaaaatttgccttaaatcaaattttaggatggtttcgtatgaaaattgtatctgattttaaagcaaatggaagaacagcctgcacaattcactgtcaaaattgcagtattagtcaattatgtttaccttttactctcaatgaacacgaattaactcaattagataatatcattgaacgtaagaaacctgtgcaaaaatcacaaatcatctttcagtcaggtgatgaactcaagtctatctacgcaatccgttcaggtacaattaaaagctataccatcagtgaaaatggtgaagagcaaatcaccgctttccatttaccgggcgatttagttggctttgatgcgattatggatatgaaacatatcggttttgctcaggctcttgaaacgtcgatgatctgcgaaattccttttgatattttagatgatttagctggcaaaatgccaaaaatccgctatcagattatgcgtttgatgagtcatgaaatcaaaagcgatcaagaaatgattttattgctttctaaaatgagtgcggaagagaaacttgcggcgtttatttacaatctttcacaacgttatgccgcacgcggtttttcagcaagagaatttcgcttaacaatgacccgtggtgatattggaaattacttaggtttaaccattgaaactatcagtcgcttgcttggtcgattccagaaaaatggcatcataacggtacaaggtaaatatattaccattaatcatatggatgaattaagtgaaatggctggtgttacaaaacctaaactgtcccattgcaatccaaacttataattctttacatactacttatcttgacgttctccccgtaccttacggacagggctgaaaaaatactcttctatcttaaaaagataatttatgccctagtctccgatctatgagaatgaatactagggctcatctctaatgaaaatatcccttccttctataaagaagatcaattcgataatttgatattaaagagccatttgtctaccaaacgcttcccttcctcgcttgaaccaaaacgggcataatccacatcaaccaatttcaccccatctattttaggtgattgtggggcaacttccgctttcacattggttggtgtttgataaagtccgtggtcacgccaaggaatttcttgaacctctttagacagaacccaatccataaacaatttcgcattatcaaggtttctcgcacctttaataatacttgcagcccctaaagcataacctaccccatctttaggtaacacataatcaaccggtgcacctttctctttttctgaagcatagccgtgagcaaagccaactgtcacagcactctctccacgagaaaggttagaggtcactaaggtacttttcacatattgagaaatgttgccatctaattttttcaagtactcaaaggctttttcctcgcccattaactgaataagcgtaatcatcgtcgtgtacattgttcctgaagtgcgaggatcagctaattgcacttcgccttttaagcgaggatcaagcaaatctgcccattttttcggagcatcaatccctaactgctttaatttttcggtgttaataccaaaaccaagcaccatcaaatacgcaatcgaggtatatttacctgcttcgctctcttgcaatgctttaaattgaggtaaaacctccgcttgtaaaggtgaacgataggcttctaatagccccatctgccctgcttggaaatgtggctcaatagtgccgccataccaaatatccgcttgcggattatctttttccgctttcagcttacctaaaattgtccctgttccaccgtgaataaactgagtttccacattatatttttgtgaaaaacgcttcgtcagatcttcacacaccttgttttgcacgccacaataaacggtcagctttccttcagcctgagcattagaagctgcaaagactaatggtgaaaggagaaaaaggcttgaaaaccatttttttaattgcaattttttcatttgttccacattcctaagttaaaaaagaatcttaattgtaacatttacgctacataaagcaagaataagcggtttgattttatgctaaaatggcataacactatcctattatattgatataaaaaatgttacttaatcaaattcaaataatcctgatcgaaacctctcacagcggtaatatcggctcagctgcacgagcaatgaaaacgatgggactaagccggctaaggcttgtcgccccaaaacaagcgattgacgaacaagcaatagcccttgccgcaggggcaaaagatgtattggataatgtgcaaatttatccagatttcgacagtgcaatcgcagattgccagcttgttattggcacaagtgccagattacgccatctacaaaattcactggtcgaaccacgtcaatgtggtaaattagctattcaacgtgctgaacagggtaaagtagcgattgtatttggacgagaacgggtgggcttaaccaatgaagaattattaaaatgccattatcacttaaactttccaaccaaccccgactatggctcgttaaatcttgcaatggcggtacaactcgcctgttatgaactccgaatggcttggctagatttgcaagaaaaaaccgatattcaaccgcttgcagaatacccgacatcagaagccttagaacatttctttgcccataccgaacgtttatataaagaacttggctttattcgcaacgaagcagttatgctgaaactacgccgtttatatcaacgagccgaattggaaaccaatgaattgaatttattaagaggaatgttaactgcagtagaaaagtactcgctaaagcagaaaaatgactaataataaagggataagaaattacatctcttatcccttaaatcatagctaattaactatagtacctaactatctagattaccataatacacgtaaaccaacaccaagtgcttggtcagtaacttttttgttattactgtctttgttcttgattaaacgaccttcaacaaaggtaacaacttgtttatgtaatttatagtctgcacctaacatgaattgatgagctgttgctttgtaagctttatttttgtaagtaccataagagtagtttccatacacgccagattttggagtaacatcaaatcttgcgccagttcttacgaagtcaattttctctttaacattacctgttttttcaacaccatgaccaccatcaacagctacagtaaatggagcattgacatatttaagaccaaagtatacaccatctttgtctttcttattaacagatccagatttatagtcatcatgagtataacctgctgccacagttacagattgactttccgcaatcttagctgtgtatttagcacctaaaccaaagccagatttagcagaacctacttttacgcctcccttatcatcacgctcatttgcaacattatagttagcacctaacgtcaaaccttcaatgcctgtataggtatagttaattgctgaatcagaatctgaagtaaggatatcaaaaccttttttgtttgtgttgtttgctgaatatttaattccaccagtaccaacaccgtatactttatcaaaaccagcttgaccaatgctatcaccgattacagcttgtttaccaaaagaaatttcatgaccatagccacctaaaccgacgtaagcatattttgttttaacatcgccccatcctgcagcatttttagaattactgtcaaggcgagtctcataacgaccaaaaccgtaaagattctcattgatattatgtttgatagaaataccgaaacgagaactattattctttaagttagtgtgaccacgtgttgaagattgacctttctcttttgtggcttgttcttctaaaagaagacgcaattgaccatcaaaatcaacttttgtaccttcattttcataaactgttacagctgatgctgatgctgcaaatgccgctactgctaatgctactagtgtttttttcataatgttcaccttaagtttttagtttagctaagattactcttattaaggtataagagtaaccgatccatatctgccattaccttcccatgtaagtttggtaaatgccgattgcgtgcgtatgattgcaaatttgtagagtagtgtcaatatcttacataaaaaaacaaaaaaacattttctttaaaatcaataagttaataaacccccactccaaaacaagtattcagagataattttttaaaatattgctcctattgcaataaatcacataactatatgatttaaaaataaaaaactcatagcaaataaagatttataaccttttttctaaaaatgtgagtttcatcacatttttagaaaaaatagaaagattatttttatcaaaaataaatttgaaaagagatgtacatacattaaaatatctatacgcttaatacagagaataaaaaatgggtaattttacagatacaatcattacaaaattaaacgacttttctcccatcttgtctctgcaaatctctatctatagccactgctttaaacttactcatggctccgtcaaagaattcatacaagaaatactagaaacatgttcacatattgagcagtcaacttcccctgaaataactgaagtttatactcaacgtttaattgaacaatatgatgctctacaaaaaagtattcacctcaaggataaaaagtcagattcccctattttctctcaatataaatttactaagagtattcatacattatcaaagaaacagaagttacatgaatactataaagcgttgcgtgcattgaatgaaaaactctcatggctcattgaacaaaattaccattaccctgagtataggcatatgctctcaataaagatacaagaaacagagaatagaaaacaaaaatgtttaaaggcgattgaagaattgagctttaatcaggaatgacgggagaagattgacaatatattgttgctaatcttatcaatctctagtagtgtctaaacataacactatatctatatatgctatgctctaaacagatacatcatactaaaaagagcccatagaaaatatcctctcttaatagagaggatatataaaattgtaatactaccgttttgagtattgtggacgacgacgtgctttgtgtaaacccacttttttacgttcaacacgacgagcatcacgggtaacaaagcccgcagcacgtaacgctggacgtaaagtttcgtcgtattcgatcaatgcacgagtaataccgtgacggattgcacctgcttgaccagaaataccaccacctttaacagtgatgtataagtctaatttatctgttaactcaactaattctaatggttgacgaacgatcatgcgagctgtttcgcgaccgaagtaaacttctaaagaacgttggttaatggtgatgttaccattgcccggtttgataaatacacgagctgaagagcttttgcggcgacctgtgccgtagttttgatttgctgctgtcatttttatgctccgtgattagatatctaaaacttgtggttgttgtgctgcgtggttgtgttcgttacctgcatacacttttaatttacggaacattgcacggcctaatggaccttttggcaacatacctttaaccgcaatttcaatcactgcttctggacgacgagcaatcatttctttgaaggttgcatctttaatgccacctacatagccagtatgccagtaatagattttatcagtttcttttttgcctgttaccgctactttttccgcattgataacgatgatgtaatcacctgtatcaacgtgtggagtgtactcagccttgtgtttaccacgaagacgatgtgctaattcagtagctaaacgacctaaagttttacctgtcgcatctactacataccagtcacgtttaactgtttctggttttgctacaaaagttttcattaattaaataccaaaatttaaagtttaaacccaatatcctaatggatattacctattaatacggtagaatctgaccccttcgagtcttattcagaccaaacttatatggcgggaataccatacaaaaacagggtggcagaattatacagatttccttgagaaaaatctaaccatttttgataaaaaatttatttttgtggatagtttcaaaaaatgaatttcttttccttttcatcctgtaaataacatgataaaaattaatgacatttactcaatccacttaaggagtgcatatggaacaatggtcaggtaacgtgtggactgcaattattgcagcatttattgttggttgtattattagctatgttgttgtgagagcaacaaatagtaatgtcaaaaaacaactcaagcttgaagccgatttaaaagaaactaccaaaaaattggacgagcaaaaacagcaattagagcaacactttgagcaatctgcaacattgcttgcgactcttgctgaagactataagaaactctatacccatttagcaaaaggttcagaatcattattaccatccgattctgcaaaaattgagtttttccaacagcctaaaattgaaaataaacctcaaacagatgaagatcaacctaaagattattcggaaggctcctctggtttactaaaatcctagtattcatatattattgaatttaagagtagggaatcccctcttaaattctctttaactacatttttcttagaacatattgtctttattatcagaaaatttgatcgaaaacattatattaattttaatttcagattagaatttgaaaaaattttttaacttatcattaacaggaaaatacaatgtcttgtttatttattacaggcacagatacaaatgtaggaaaaactatcgttacaagggctctattacaaacaatatctaaatatgaaattcccattgtcggttataagcctattgcgtgtggtggcgatgattctttacccacagaacccaatcaagatgattatgcctgtgaagacaatagtgatgtcctcattatacagaacagctgcccttttcctgtaaaatatagagaaattaatagctattcttttatccattctagtacgccagtatttgcagcgctagacgcagtacgccatatttctgttaataaactggatcacgatcttcaacgtttacaccgacaatatgcaaatgttcttgttgaaggcacttatggctggttaacacctattaataaagacctaagttttgctgattgggttaagaaaaatagaatgccagtcgtacttgttgtgggaataaaagagggttgcgttaaccatgcacttttaacagcggatgcgattcaacagagtggggttaatcttatcggatggattgcaaatcgagtaaatcctgggctacgtcactacgctgaattaattgaactccttagcaaaaaaatcaatgctccattactaggacaaattccttatattggttatcctagtaaaaaagaactatctgagtatattcagaacccagagcctctattaagttttttccataaataatctaattgctggctctttattgataatagactaacaatcatgactacaaaggttgctatataattttagcaacctctctgatttctatgctattttagctagttaaataattcataaatgcagtaattgcacctaagttaactacatccacgaagaatgcacctacaagcggtatgattaagaatgctttgtgtgatggtccaaaagtttctgtgacagattgcatgttcgcgaccgcagttgcagttgcacctaagccaaaaccactgtgacctgctgcgagaatggctgcatcataattacttcccattactctaaaggtcacaaaatatgcataaagtaccataactatggtttgagcaataaggataggtaacattgagccagcaaggtctgctaattcccaaagtttaatgctcattaatgcaattgctaagaataagcttaatgatgcgttaccaaatacgtcaatagcacggtcaaacatatcaaatttaaacactaacgttaatacgtttcttaataccacaccaaaacctaatgcccatacgaattgaggtaaacctgaatcagggaatactttaaccataactgatgagaatgctagacacgctgcaaataatgccattgtttcgatcgttgatgttgctgtgattaagcgtacattgtcagcatcttcaaatgtatcatcagcatattttgcttctacgctttcaacttttacactgtgtttagatggggtaattttcattttgttgataagacggcgtgctaatgggccaccgactaaaccaccagctactaaaccaaatgtagcagatgccattgccatttccattgcacctgcaagcccatgtttctctgcaaaaacagttgcccaagttgcacctgtgccgtgtccgccagttaaagtaatagaacctgtaattaaaccaacaagtggatcaataccaagtagcatagctaaaccaacgcctacaccattttgaacaaggataaatatactcacgataacgaggaaaatgacaagtgggattccaccttgtttcaaacgggaaaaatctgcggataagccgatagatgagaagaaggctaacatgaaagctgtacgtaaagagctttcaaattcaaaggtaattccagcgaatttatatagacaaaaaatgataccagcgataaataaaccaccagcaacagcctctgggatattaaagtcttggaagaacttaattttatttacaaatactttgccgagaagcaaaacaagcgttgcggcgataagtgtgtgataaccgtttaaaacgattggctccatatcattactcctaatatatgatttatgaaggggcggataatattataaagatttagcattgtcaaaatggctatttgattatttagtcgcataaaaatattgttatggtagacatttctctattattttttgagttagatctcattttttgcttggggattttggtagaatcgtcgcagttttatttttttatgatgaggcttttatgagcgaaattgcattaacagtaagcctattatccttagttgctgtcattgggctatggatagggcatattaaggtgaggggcgtaagccttggtattggcggtgtgttatttggtgggatactggtttcccattttatgacgcaatatggtgtcaaacttgatggtcataccttgcactttattcaagagtttggtttgattctctttgtctataccattggtattcaagttggtcctggtttctttgcttcattacgccaatcgggattaaagcttaatgcttttgctgtgatgattattgggataagcggtattttagtgattttattacacaaaatatttgatgttcctcttcctgtgatattgggtattttctctggtgcggtaaccaatacgccatcattaggtgctgggcagcaaattctgacagaattaggcggtgagtctattactgctgtgatgggtatggggtacgcaattgcctatcctttcgggattatcgggattctattagcaatgtggcttatccgtattatttttaaaattaatgtggataaagaagctgatgagtttgattctgcaaccaacaataaaaaagatggattaagtacgctgaatgttcgtattacaaatccaaatttgaatgggttgatgcttcaagagtttcctgattttgaactgcacgaagtggtttattctcgtattaagcgtaatgatgagttgtttgtgcctaaagtgcataccaaaatccaaataggcgatattctgcatcttgtgggaacaaaagctgcgttgcataaaatgcaactcattcttggtgaagaagtgaatgtttcactttcgacaaaaggcacaatgtaccgcacagaacgtgctgtcgttacaaatgaaaaagtatttgggaaacaaattcgccaattgatgttaaaagggaaatatgatgtagtgatttctcgcttaaaccgtgcgggggttgagttagttcctaacgggcaaatgacattgcaatttggtgacgtgttgaacttggttggtcgccaggaagatattgaggctgtgatggcgattatcggtaacgctcaacaaaaattacaacaagtacaaatgttgcctatcttcatcggggttggtttaggggtgttactaggctctattccaatttatctgccaggtttccccgttgcattaaaattagggttagctggcggtcctttagtcgttgcattaattttggcaagaataggaagtatcaaaaaactctattggtttatgccaccaagtgcaaacttagcattaagagaaattggtatcgtgctttttcttgcagttgtaggttggaaagcaggcggaaacttcttgaataccttattaagtaatgatggtttagcgtggattggttatggtgcgatcattacttttattccattaattgttacaggactggttgctcgtatttatggtaaattaaattatctgagcctatgtggattgcttgcaggttcaatgacggatccaccggctttggcatttgcaaatggtattaaagagggcaatggtgcagcagcactctcttatgcgacggtatatccattagtgatgttttgtcgaattatcttgcctcaaattctcgctatattattgtgggtagctggctagtcgtaactaagcaatctagttattgacagttcaatagactagattgctcaatttcaataaaacgcaataagtttccaacaatatttaggatccattcacgccatttttataggattataatttattttctatgataaataataggatgtcttaatcacggatttaacgttataatgagaaataaatctattttttaatggaaatactactttatgtatcgcttaaccttttttttgatatctactttgctgtttaattcctccctctctgccaaatggctaaagatcaatgatgtagactatatctggggaccatttaaaatctataatatttcattattctctgaaactggcagttatactaatagcacacgcccattaatgctgactctaaaatatcaaaagcccgttgaagggcgtgattttgcaatttctttagctagatcttggtctaatttaggcatcactctgcaaaatcaagataatgtggttgatcgtttgcgtaaaattttacctaatatcaagaaagatgattctctcagttacattgctttagaagataaaggatatttcatattaaataatattgttattcctgaagaatttaacaaagaatttaatgacgctgtagtagcaatatggctagatcctcgtgtagaaattgggcgtaaacttgtcaataaagaagaaaaaaccttcattgcaaacatccctagagttttagagacacaaaaaccacaaaatatagaaaataatataggagtacatgaagaatcaatagatcctgtggtggactcaagcaaagtatctaatgatatcaaacaaaacttagactcttcaataatgcctagagtacaagataagcctttaactcagtcaaatgaagagaatatgaaagaagcagaaaaaccacttgaagattcagaaattgatatttctcctcctttagatcccataccagaaggcaaatatctaaatatatagctgattattaaagtgtttatagcatatataataaatcgacaatgccgattcagaactggaaactggcgatgaatcgatttatgattgattttggtgatcgcctagacgatcaccgttaagttgaaatgggtgtttacacagaatttgggatagggtcgaatcatctaagcgctaatacttcaccgtatgcccatagctttcaataatacctttaatatgctctaacgattctttcgtcggtggcatcacatcttccaattcatattctaaccctaaggttttccatttatgtgcgcctaaacggtgatatggcagaagttcgactttttctatgttgtccataccttgaataaactgacccaataaatgaatatcttcatcggcatccgtataacctggtacaaccacatagcggatccaagtacgttgattacgtttatgcaaataacgagcgaagtctaaggtacgtttattagagacaccgataaaatctttatgaatttcttcgttcagctgttttaaatcaagcataacgagatcggttacatctagcatttcatcgactagctctgaataattccgtacaaaaccatttgtatctaaacaagtatcaataccctcagctttacaagcacgaaaccaatcacgcacaaattccatttgtaacacggcttcgccacctgatgctgttactcccccgcccgttgctctcataaaatgtttatacgtcacaacttccttcattagatcttctacggagatctctttcccaccttcaagatcccaagtgtcacggttgtggcaatatttacaacgcattaaacagccttgtaaaaacaaaataaaacgaatcccaggcccatctactgtgccacaagattcgtaagagtgataacgtgctaaaacagtcattctttttcctttaaataaagtacgattaggacaaatgtccttaaacatttctgctaatcgcaattaatgcgtaagatacaataagcggtcagtttctgcaaaagttttgcaaaatctgaccgcttaattagtttaaactaaattacatcgactgtgtgaaagtacgagtaattacgtccatttgttgctctttagttaaagagttgaaacgcactgcgtaacctgaaacacggattgttaattgtggatacttctctgggttttccatcgcatctaataacatttcacggttcattacgtttacgtttaagtgctggccaccttcgatggttgattcgtggtggaagtaaccgtccattaagcctgcaaggttacgtttttgagattcaagatctttacctaacgcatttggtacgattgagaaggtataagagataccatctttcgcgtaagcaaatggtaatttcgccacagaagtcaatgacgctaccgcacctttttggtcacgtccgtgcattgggtttgcacctggtccgaatggcgcacctgaacgacgaccgtctggggtgttacctgttttcttaccgtaaaccacgtttgaagtaatggttaatacagactgtgttggtgttgcattacggtatgttttgagcttctgaattttcttcataaagcgttcaactaaatcaactgcaatgtcatctacacggttatcgttgttaccgaattgtgggtattcaccttcaatttcaaagtcaagtgctacgtttttcgctacgccaaccacttcgcctgctttatttttgatttcgatgtcgccacggattggttttactttcgcatatttgattgcagagagtgagtctgctgcaacagaaagaccagcgataccacacgccattgtgcggaatacatcacgatcgtgcaacgccattaatgctgcttcataagcatatttgtcgtgcataaagtgaatgatgtttaacgctgtgacatattgtttcgctaaccagtccataaagctgtctaaacgggtcattacatcatcgtaatctaagtattcagacataattggctcagttttcggtccaacttggtcacctgatttctcatcaacaccaccattgattgcgtatagtaaggttttcgctaagtttgcacgagcaccgaagaactgcatcattttacctacgatcatcgggcttacacagcaggcaatcgcatagtcatcgttttggaaatctggacgcattaagtcgtcattttcgtactgaacagatgaagtttcgatagacactttcgctgcatagcgtttgaaaccgtccggtaaactttcagaccaaaggattgttaagtttggttccggtgatggacccattgtgtaaagggtgtgtaatagacggaagctgtttttggttactaatgtacgaccatctaagcccatacctgcgaaagtttctgttgcccacattgggtcgcctgagaataattgatcgtactctggggtacgtaagaaacgaaccatacggagtttcattactaagtgatccattaattcttgagcttctttttcagtgattttgcctgcttttaggtcacgttcaatataaatatctaagaaggttgaaacacgaccgaaagacattgctgcaccgttttgtgatttcactgctgcaaggtaagcaaagtaaacccattgtaccgcttcttgtgcgttagttgctgggtttgaaatgtcaaagccataagatgctgccatttctttcattttgcctaaagcacggtgttgttctgcaatttcttcgcgtaattggattgtcgcttgaatatcttcgccacgctctaacttctcttgtaaagaggtaaactgttttactttatctttcattaagaagtcagcaccgtaaagagccatacgacgatagtcaccgataatacgaccacgaccgtaagcatcaggaagacctgtaattacgcctgatttacggcaacgtaaaatgtctggagtataaacatcaaatacaccttggttgtgggttttacgatattcagtaaagattttctctacttctggatttaattcacggcgataaactttacaagagcctttcaccatattgataccgccaaacggcataattgcacgttttaatggtgcatctgtttgaagacctacgattttctctaaatctttgttgatataacctggtgcgtgtgaagtgatggttgatggaatatcgcaatcaatgtcatacggttcgtgggttttgttttccactttgattttttccatcacttctgcccaaagcgttgtagttgcttcggttgcatctgctaagaaagattcatcaccttcatacggcgtatagtttttttggataaagtcacgcacgtttacatcagtttgccattcacctggtgcaaaaccttcccacgctttcttttgagcttcggttagttgagtcattttaagtcctcgttagttaatgtaataaattggaacgcaagcggtgcgattttgcaaaaacactgcgaaaagtgaccgcttacaagttttgaattaatgtttttttagatgcaaaaaccactgcaccataccgatgaaaaatgcaccaccaacaatgttacctaaggtcgctggaattaaatttttcaccacaaaatttgccattgttaaatcagcgaattgactaggatcaacccctatcgctgtccaaaattcagggcttgcagagccgtgaattaacacgcccattgggatcataaacatattcgccacacagtgttcaaatccagatgccacaaacatggctatcggcaaaatcataatgaacgctttatccgtcaggctcttacctgcatacgccatccataccgcaatacagaccatcagattacagaaaatccccaagctgaatgcttcaatccaagtatgatggatcttatgttggactgtttttaaaatagtcaagccccactgcccatttgcagccataatttcaccgctaaaccacactaacagcacaataaaggtcgcaccgatgaaattaccgccatacacaacaaaccagtttttaaacatctgagccaaactaattcgcttacttgctttagctacaatggtcattgtcgtagaagtaaaaagttcagccccgaaaacaacacacattataatgccaagagagaacacaacaccgccgatcagttttgcaacgccccacggcagttcccctgcaccgacttgtgttgttgcataaaacacaaaggcaattgaaatataagcacctgcggtaattgctgaaatgaaagaataaaattgattttttgtcgctttataaaccgcaccatcttcggcgattttagccatctctgctggagaaaacatcactatccttaaatgaaaatttgaaaatttacaaaatttgttgagaattatagacctgttgaagtgatcatcaaataaattttcaacataaacagaataaagtagaattatttcttgatccacatcaagttttaacattgattaaaatttaacaaaacacaaatttaacagaacagttacaaaaatgtccgattatttgaccgctttacttgggattttccttgacaaagaaaatcaatatttaattatgtttgccagcagttttttaagttctacgctactgcccagcaactcagaaatcatcttcagcacctttgctacacaagcctttgcgaacaaccattccttatatggattgtttatcagtgccacattaggcaacagcttaggtagcctaacaacctattttctagcaaaactttttccacccccaaactatcacgaacagcaaaatcaacgtattcgatttgcacttaaatttagccaacaatacggcgtttgggtgttactgtttagctggctacctattgtgggcgatctcttttgtggtgtcgcaggttggttacgttttgatttttggaaaagcctatgtttcatcgtattaggcaaagctattcgttatgcattattgctttggagtgtttatttggttgttggttgagaatgaatagtctagaatatcgcaaatccattcttgttgagaaattttatgtcaaaacaactgcctgaaatcaaatctgtttcggtgattgccaaaactcgcatttttgaagtgcaatccgtcgatttacgtttttcaaatggcaaagaacgtacttacgaacgcctaaccccacaacgccgttcttccgtaatggtcgtgccgatccatcaaaatcaactcatcttggtaaaagaatatgccgtagggcctgaacgctatgaactcaccttccctaaaggcattgtggatagtggggaagatcctgtactgagtgcaaatcgagaattacaagaagaaataggttttggagcaaaaacaatcgaaccactgcgttcagtgtatagcggtcctagccatatgtacggcttaatgcaccttttcgtggctcaagatctctatccatcacagctagaaggcgatgaaccagagccacttgaaatcatctattatccattaaacaaaattgacgaactgcttgccgaccctaattttgccgaagcacgcaatttatccgccttatttttattaagagaatatctcaatgccaaaaactagcctacatattttatggatttatccactacttacccagatactcggctctgccctattacctctttttagcgaatttagccaagggggaatgttggttgtttttgctttatttaccgtcccagcttttctatttgcattagtcagctacaaacagcaatatcaccaacgtaacatcattcaaattgcctttttctcaggggtaataatgttcatttacagccttttttcattttcattgatgttagcttttgatgaatacaccagccttgaagatcctattcccctatgggaacaatcccttgccgtgatcttatttgctctgacctttgctttagcaaaagtaatgtatgctctattggtgttgagattgtttttgccgaaggtgtaagtcgcttacattaatagaatggagatagacacttcgggtttaataatggcgagagttttttagatcattggttatccttatattcaagttaaggcagggtgagaaacttcctcctaataaatttataggtctctcctagataacgactaaaatccctatttaggttaagataacccaataagcaaaagttatctaagtcagtataaacaaaataaacttattgagctgtttgtagcagatatcactgctcgaacagctgctgagttgataaatgtaaataaagctaccgcagcctattatttccatcgtctgtgattgcttatcaatcaaaacagtctacatcttaagaggttcgatattcaagaacaagtgaagcccggcagtattgtttacaccgatttctaccgaaactatgataagtctgatgtaactgagtttaatcattttcgcatcaatcacagtacctacttcgcagaaaaacaaaaccccaaacgaaaaggactaagtccgatacaatatcgaaatcagtcctttgaatagctgtataacttttgaaggtcagatcattttattcatattttaaaaggtaatttgaagccttttaccataaaactttaggggctgtattagattagctagtataccaacctacatcagcccctataaataaggttgtaagagcaaattacatttgccccaaaatgattgcaggaatgtcagggcgaagtcattcgcgcctacattttatttacacaatctcactcggcgtaaagaaataggcaatttcacgttttgcagatgtttcagagtctgagccgtgtactgagttttcacggtagcctaaaccaaacattttacgaatagtgcctagtttgcgttcttcaggtttggttgcccctattaacaagcggtagttttccacggcattttcgccttctaacaccgcaacaacgataggctcagaaatcataaatgccacgagcggatcaaaaaagtctttgccttgatgttctgcataaaaaccttccgcttgttctttggttaagtgaagcatttttaacgctttgatcgctaaaccatttttttccatataacttaaaatttcaccgataagatggcgtttagtcgcatcgggtttaataatggcgagagtttgttggatcacttgttgtccttattattgggttaagacagggtgagaaatctcaccctgagtaaatttatttcacctgcataccagccgtcacgccgctatcagcagagagcaagtagagatctgcaccgcctgtgccagcagataaaatcattccttccgacataccaaacgacattttgcgtggggcaaggttggcaatcataatcacaaatctgccttcaagctcttcaggttgattgtacgccgctttgataccagagaagacttggcgagtgtgatcgcctaaatcgagttcaaaacgtaataatttatctgatttcggcacagcttcacatttcaatacttttgccacacgcagatcgagtttagcgaagtcgtcaatggtgatttctgaggcaattggttcaactttggtttcacaagcggtcatttcttttcctttttttgcagtttctgcttttacgctttcggcgaaaagtgctttggtttcttcaatcacagcgtcaatctgttttttctctaagcgagagaagagcgatttaaacggtgcaatgctatgggcaaatagtggtgaaccgatgttgtcccaacgcagttccgtttgtaaaaaggcttcggcacgttctgcgagttttggtaatactggtttgagatagctcattaatacacggaatagctctaagcccattgaacagaccgcttgtaattcggcatctttgccttcttctttggcaattacccaaggggctttgtcgtcaatgtatttattggctttatccgttaatgccataatttcacggatcgctttgttgtattcacgcgtttcaaaataagtggcgatatgctccgattgtgcaacaaattcatcaaaaagcgcttgattttctagtgttgaagccagtttaccttcaaagcgttttgtgatgaaacctgcggtacgagaagctaaattaactaacttattgacgatgtcgctgtttactcgttgtacaaaatcttctaaattgaaatcaagatcttcaatgcgatcattcaatttcgccgcatagtaataacgcaaacattcaggatcgatatgttttaaataagtgctggcttgaatgaaagtaccacgggattttgacattttctgcccgtccaccgtcacataaccgtgtgcaaagacgtttgtcggtttgcggtattcgcttccttctaacattgcaggccagaatagactgtggaagtaaacaatgtctttaccgataaaatgatacaactcggcatcactctcttttttccagaaatcatcaaagttcaagcccgtgcggtcgcaaagatttttaaacgaagccatatagccgataggggcatcaagccaaacatagaagaatttgttttcgctatctggaatttcaaagccaaagtaaggtgcatcacggctgatgtcccattgctgtaaaccgctctcaaaccactcttgcattttattggcaatttcaggttgaagcgagccagaacgtgtccacgctttcagcatttcttcaaagcttggtaggtcaaagaaaaagtgttccgactgttttaccacaggggtagagcctgacactactgaacgtggattgattaaatccatcgggctataagtagaagcacagacttcacagttatcgccgtactgatcttccgctttacatttcggacaagtacctttaacaaagcgatcaggcaagaacatatttttttcaggatcgaacaactgcgagatcaccttgcttttgataaaaccattcgcttttaattttttatagatggcagaagtgtattcacggttctcttcgctgtgggtggaatggtagttatcgaaactgatattaaaaccggcaaaatccgcaatgtgatcggctttggctttttcgattaactgttcaggggtaataccgagtttatccgcattcaacataatcggcgtgccgtgagcatcatcagcacagacaaagtgaatttcgttgccacgcatacgctgaaaacgcacccaaatatccgcttgaatatgttcaagcatatgccctaaatggatcgcaccgttagcataaggcaaagcacaagtaaccagtatttttctttttggatttgacattctaaatctctctaaaatatagcaaaaaattatagggattgtagcggaaaagggggggattgtgtagttaagatttggagagagagggatttttcaacgctgtttctggcgtttctcttatttctaaaagttataaataactaataacacattatcttttgaaaaaattaatttttttagataaaataccccaataagggctggtgcaaagtaatcttcgttatccgctaatgctcgcctacataaaattaattacgatctttataaagagtattaagcgagaaattactccacccaagtttcataaaataaattattttaaataagtggtacaaattatgaacatcaaaaaatcaatattatccactatgcttttatcttctgctgtgttgatatcctcttgtaagaaagatggcactggcggaaattctccccaacataataaagaacaaaatccagttaattcgtcgataggtagccattttagtgctgaaagtagtggaactacaaataatggatttaataaactccctgacagacagacagacagacagacagacagacagacagacaatcataactcgactacctctcattcttccaacactaatcaacgtttaaatggctctagcgattctgcctcgtcaaataattcgctaacttctgataatcaaacgccgtctgatgagccaaataaggtagatagctcaagttctgctgatagttcaacaacttcaaatgaaccaaccatttcggataatcaaacaacttcggacagtccaaatgctacagataaacctagtacggaaaatactaacaatgaacaagctacagcagaaacgacagataagcaagaagtagcaaaagaggaagtaaaagaggaagtaaaagaggaaagaaaagaagaaatcacagaagagccaaaagtagaaaataaagaaaaaacacaaacagaaactgaaaatcaacctcctagaacagaggaaaatccacaggcggaagaaaatttaccagcagaggaatcaactaagcaggaattacctgcggaagatccatctaaagtggaatctccgcaagagaaacttcctcaagtagaagaacagaaacaaccgattaataccgaaacagaaacttcagtagaagactctaaggaaaaagaaaaaatagaggagaaaattaaaaaagatccagaagaagaaaatacggtaaattcatcggataaccgtaatgaaatatcaacaaataatgagctgacaaatagcgaagcgacaaataatgaaatatcgaacaatactgatccggtaaataatgttgttcataatgataatgtttctggagaaaatataaatcaagaaaataataatttatctgctggaaatagtgatgataataaaaatactgatacggaaaataatgtatctggaaataattcggtagaaaataatgatgttactttaaatttaaataataattcagaatctacaactccagaaaataatccttctacgcaatctaattcatcaataaatcctgtggataatcagccttgggctaaacctgaagttgagaaattagataaaaataattatcagaatacacaacaacaatctaaattcactaataaaattgggattgtggatatggattataatgtgcgtgatgatcttggaaatgcctttaaatttgaaaatggctcagatcgcattatcttaaatgctggtttatatacacgtgcaaatggacataaaagctctcatggtacgatggttgctggtgttatcgatcagaaaaacaaaaatgctacgctttatgcttatactgcaaaatccgcttatatggaagctgtaagtgcatctaatcagcattatgatgaagcatacagacatggcgtgaggatttttaacaactcttatggtaataatccacatagagacagtgtaaatggaaaagggtggaaacaattatcagatttacatctgtataaacaattagctgaaatggcagaaagagacagtatttttgtatgggcatcaggtaatgatggcagagataaaaaaactggacgaagtgaatatgcaaccatagaggggcatgtgcctgtaatacgagatggagcaagaaaaggctggattgttgtaacttcaataaacccacaaaatagtggagtgatggaatatgcaagtcagattggtaaagatgccaaaaactggggtattgcagctcccggcgagtggtacttatttggtgataaagtacgaacagagggaacctcttttgctacacctgttgttactgctgccgtggctaatgtttgggaaaaatttgattggatggatcatcatttagtgacccaaactatattatccaccgcaaataaattgggttcaagtgaagttactgaagaacctaacgaacgtgttggttggggtgttttaaatcaagatagagcattaaacggacctgctagatttgatacaaaacttttaaccaatgataataaaacccacgtcgtagcaaaattagattataaatatcatactgaccgcactaaatatacttggtccaataatattaaaggtgacgccggatttaaaaaacaaggtacaggaacactttatctcacgggttcaaattcttatagtggaaatacagttatcgaaaacggaactttggtaattggaaatgaattaaaacaatccacagtagaaatccagtcacagggaacattattaacgaaaaatttaaataactctcaaacagaagttaaaatagtaaaaaatgtagataataaaggttccttggaggtttatggaaaggggttaattattgagggtaattatactacttcaaataatgccagaacggttattgatatagataaatctaaattaacagtaaaaggcaatgtcaatttacaaaattctcgtattgtagccgatgttgaaaatattaatgaagtggtttcaagagatcctcaaacaaaaaccattattgagtctcaaaatcctattcaaaattataatggagattacaaaatatcggatcgtgctaacccttatattgatttaaaagaaattaaattaaaagaagggaataataaagaaattattgcaacctataaacgaaatgatacagaatttgtattaaaatctgccaatgaaagttcattaaagaatgtttatactgcgagaagtttagatcttattttagatagtgcgagtgattcaggaaatacaaatagaaatctcagaagtgcagcattatcttttattaatgctaaaccacaagcggtagcttctgcagtagattctttaagtggcgaaatatatccagcagtacatcaggtagcactgaatagtattaaaaccttgaatagacaaattgctaaacagcaattctcaaatattcaagatattaagtcttatcatatttatactcagttagctacacaaagtttaaaactttatcagaatgataattttggatttgcagatttaaaaaatagtgcagattcacaattagttggtatagataagcaatttaatgcctttacatttggtatgggattgcaacgagttcatcaaaaattatctcctttatctaataaagatcaacaagttggaaaagtagatttaaaacaacacagtttcgccttatacggaaaatatgattggaataaatggtattatctcagccaaatcagttttactgatattaaaggaaaattagatagaacattgttattgcctaatggcacacagataattaaagctgatttaaaattacaaaattattctttttataatgaaaccggattaaatctacaatatgaaaaattaagatttaatccatatgttgcgttacatattaaccgtttaaaacaggattccattaatgaaaaagaagatttagcattaagtattgataaatatcataaaacccattatggatatgaattgggcttaagattaaatcaatcattatctgaaaaatttaatataaatctagatatttcttatctttataataagaacaatatggataatatagtaagtggaaaatatattatttctaacactgaaactaaattatatggaatgagattaccaagatatgaatttaaaactagtttaggtatgggctattatcttactaaaaacctcaatatttacgctaacatagcttattatagattgtggaataacccaatgaaatcctattacaaagaaggaaatattggtgcgaagtacaatttctaattgtaatctgataaacaactacttgaaagcacattcataaccccgtgtaatgcccacggggactttttgcttaatcattgctatattctttattttcagactttggcaaaatgggcagttttttgttcatatttcaaaaagagggcttaaagccttgtactataaggctttaagccactttttagcaacaaatttgtctattacacattttttgccgaatcaaaccgcttgttgtatgggttatttatcgaatttcctcctttccatcacgttaatccgttattttatttatcaatacaagcggtgagtaatgtaaagaggaatgaaaaccacgcttcctataccccaaacaagaaccattccagtagcttcactatctaaagttattttttctgaatatgctataaattgtgtttgtagtggctgttctaatttggctttattcagaactgcatcttgattttcaattttgaccaacttcccataaatgtcataaaactgttctgatgatttcttattatgtaaagaagtgagttttaccctagactcaatatcaggtgttttcatttgatttttgatataaataatctctgctttagtaacagatttcattttttcagattgaagcaaacggataaattcggtggttttccgctcttgataatcagcattctccttgttactgctttcaaattaataactatgcaaatctccgacaacatataatttattatcagcaataaaaaatgctcggattgtttctgttttggtattttcatcttgatactctgttttagtacaagcggtcataaaacataaaatcaaacagtaacaaaaaaagcgttttaagatttgcatagttttctcctcagaataactatgaaatagccaccacatctggcaatttcactaactgattaagtagtaattccatcgctctttcactctgaacggtgacatttaacgtaattcccgaaccattattttctgcattgagtgatagcacttcaaacccacggtggcggatcactctgagtaaacgctcaagggtttcagggcgtttattagctttgataacgaattgatattgttgcatttttcttctccttaaaccccaatgtcttcatctaacatatctgtattgcacgcatttggtggaacgagtggccacacattttcttcatctgggatacaaacgtgcaataaatacgctcctttgctgttgagtaagcggtctaatgcggttgaaacttcccctgctttttcaatgcgttctgctggaatgtcaaaggcgttagctagcatcacaaagtctgggttgtcatctaaaatggtttgactgtggcgaccatggaaaaagagcgattgccattgacgcaccattcctaaacgttggttgtcgagtaacagaattttgacaggtaaattgccacgtttgattgagccgagttcttgaatattcatcataaaagagccatctcccgtaatcacaatggttggatccgttgggcgagctttgaccgcacccgccgctgctggcagaccaaatcccattgtgccgaacccagcagaagtgatgtagttttcaggggaataatgctgcatatgctgtgctgaccacatttggtgctggccaacgtcagtagtaataatcgcattttgcggtttgcgttgtgaaagggtgtgtaacaacgcccaagggtcgatttcgccttcgcctacattttcttgatagctgaagtcaaaatccgctttcagcttacgcacatcagctcgccagctttcaatctctaacggttgggtaagtgcggtcactgcctcgattaaatctccttgcaatgctacatctgctttgcgtagcttgttgatttcagctacatcaatatcaatatgaatcactttggcgtgcggtgcaaaggtgtcaagtttacctgtcacacggtcgtcaaatctagccccacaagcgatgagtaaatcactttcttgtactgcatagttagccgctttcgtgccgtgcataccgatcattcccatatagagtgggtgttgtggcggaatggttcctaagcctttcaaggtagaaacagacggaatatttgcaacatctaggaaagatctaaccgcttgcacgccatctgccataccaacaccaccgccaacataaagaatagggcgttttgcttgagctaacaagactttggcttgtacaagtgcggatggattttgtgttttagccgccacttttttatagacgacaggggaaagtgatgttggagcgaattgcacatctttaggaatatcgacaagcacaggaccagggcgaccactttgtgcaatttggaacgctttggcgataatttcaggtagttcatcaatgttttgcacgatgaaactgtgtttggtacaagcaagggataagcctaatacatctgcctcttgaaaagcatctgtaccgataaaggctgaagccacttgccctgtaattgctacgataggaatagaatccattaaggcatcgcctaagcctgtaactaggttggttgcccctgggcctgaagttgcaatacaaacgcctgttttgcctgttgctcgagcataaccgatagcagccattgcagcaccttgctcgttgcggcaaagtagatgatctaaacctgaatcgtaaatcgcatcatagacaggcataattgccccacctggatagccaaaaagagaagtgacgccgtgagctttcaaacactcaacgaccaaatttgcaccgttcataaattaccttttaatgttgtgtcgctatttagttaaggcttttatacaataaaaaaaccctcactaaaactagcgagggtttgtggatctcattatacaattctaattgcgagccaacttaacccccgcggtgataataatcaccacgaggttaataataatcaggctaacaagagaacgtaatgtcattttcatttatcaataaaagctgaatggctatataaatagcatattttttgcataaaacaaatgaattttttatctctagatgaaaaaagcaaacgattagctttaaatagattaaatttacttgagttgtggggggctagggttgaaaatgttcaaattatcactatctaatcggcgattaacttctataaggaaatttctatgccattacttctctttttagctgggctatttttatacatctacattgaaatctctctgttagtaagcgtcggctctgctatcggggttttacccttgattttattaatgatcactatttctgcggtcggtttgtggttagtgaaattaagaggaataatgaccataatgcagatccgccaagagatcgcacaaggaaagatcccggcacaagcggtcacctcttcgatcttttttgcaatcgcaggggtattgttgattattccaggttttctaagtgatattgtcgctttgctacttcttttgcccatcactcgccaattgctacaggcaatttttatgaaactctttgcaagccgtgtgaaatttatgtcctttggttcaatgaacaggacttcctctcaaaataatacgacttttgaagcggaatttgagcgtaagcaagatgaagataagtggttgaaataatgataaatttcataatgatacatatcaaagattcacgacatataatgagattcaaaaatcaatatctgaggtctatttttcctttcgcaatcgcgataaaaaagagtaaaattagtctttattttgacgagagagaaacaaaatggcaaacattcgtttagcaattgcagcagattttttattagccgagaaattattagaagccttagaacaaagtagtttagattttgaacaaatttcagccgttgaattggaaagttttggtgaagaacattctctgcgtttcggtgcaaaagctgttgagcaaatcgctgttgaagatgtcgattggtcgcaatttagtcacgttctctttgcaggcaaaatggcaaatgcagaattgctggctcaagcggtacaagcaggctgtgtgattttagatctttacggcatttctgcattaatcggcaatgtgcctgtgattgtgccaagtgtaaacaacgaaatgatcgctaatatgcgtgagcgaaatattgttgctttagcaaatccacaaatcagccaattagcacttgccttaaaaccgttgttggaccagcctattcaacatatttttgtcacatcactgttgccatcggcgtattttggtgatgaaaaagtgcgtgagttagcaggacaaaccgcccagttgttaaacggtattccccttgatgatgaaaaaccacgtgtggcgtttgatgccgtgcctgcaaatgtgcaaggtgatgaaaaacacctgccgttctctcgtgccttcgagttacaacttgcaaaagttctgccaaatctaaccgctagtgtgactttccattccgtgcaagtgcctgttttctatggcatttcacagatgatcagcgtgcaatctgagtatgctttagatgccaccgcattaagtgagcagtggcaacaacaagcgtgggtaaaatttaactctgacaatgtaattacccctgttaaaaatggcgaagatgaagaggtaaatctcttacaaattagccaactactcaataaaaatgaaaacgcactacaattctgggcagtggctgatgaacagcgttttagcttagcgttcttggcggtggagttgttgaaagaagtaatcactagctattaacatagttggatctaaaaatacaaacatttgatataccatcactcaatcacatagcaatatattctcgtagatatggaacaaaattcttctttaactcagattctggtagctactgctgctcttgtaattattttggcgggtattaaattatccgttgagatcgttattcctttcttattatctctttttattgcaattatttgttctcctattatcaaatatctaacctctcataaagtccctttgtggctggcaatcactatactctttattttatttttacttggattcttttttctggcaggactaatcaacagtacagtacaagaatttacagcatcaattccacaatacaaaattcttctatctgaacgtattgctgccgcaatgctccttgttgataactggaatatcccggtttcaatatctcgtgaacagatccaagaacagctagacccaagcattattatgaactttgttagtcgcttattacttagcttctcaggcgttgttacaaatatttttgtactcttattagtcgttgtgttcatgttatttgaggccccaaccgctaaacataaacttatcgtggctcttagaggcaataaagatgtggaatcggaagaaagccatatcaaccgagtattacagggagttattagctatcttggcataaaaacgattgtaagcctgcttacagggatatctatttgggtgttacttgaaatagctgatgtacaatatgctgtattatggggcacattaagcttcctactcaactatattccaaacataggttcaatcattgctggtgtacctattgctgtacaagcatttctattgaatggtttttctgttggattgggagtatccgtcggtatcattgcaatcaatatggtaattagcaatattctagaacctagaatgatggggagaacccttggtctctcaactctcattgtattcttgtcactacttttctggggatggttactcggtacagtaggaatgctactttctgttccattgacaatggctctcaaaattgcattagaatcgagccctaaaacgatccattatgcaggcttattaggagatattaataaacgctaatgctcttatttttgcactttaaatacattagataacctatatgtttcttatagcactcaacctaaatattttcaacactggcagcgcaaacgattgctttttggtttatctttgtgtagaatcctcgaccctttaatcatactatatatttcttgaggttttttccattatgtctcttctttctcgttttcaactggcagaacgtggttctaacgttcgtcaagaggttattgctggtttaactactttcctggcaatggtttactccgttatcgttgtgccaaatatgttaagtgcggctggctttcctgctgattcagtatttattgcaacctgtttggttgctggtttaggttcaatcctcattggcttatgggcaaatgctccaatggcgattggttgtgctatctcattaacagcttttactgcattcagtttagtgctaggtcaaggcattagtattcctgttgcattaggtgcaatcttccttatgggtgttttatttaccattgtttctgtaacaggtatccgtgcgtggattttgcgtaatctgccatctagtattgctcacggcgctggaattggaatcggcttattccttttattgattgcagcaagtggcgttggtttagttgtcagcaaccaagcgggtttaccggtaaaaatgggtgagttcacttcttttcctgtaatgatgtctttagttggtttagctgctatcattggtttagagcgtttacaaattaaaggttctattctttgggttatcattgcaattacaatcatcggtttaattttcgatccgaatgtaaaatttggcggtgaagtattcaaattaccgacctttggtgaaaattctcaattcttaaatttagatattgtcggtgcattgaatgcagccattttacctgtggtctttgccttagtaatgactgccatttttgacgcaacaggtaccattcgtgctgtagcaggtcaagcaaatttattagataaagatgggcaaattatcaacggtgataaagcacttacttcagattcattaagtagtgtactttcaggtttatttggtaccgcgcctgcagcagtatatattgaatcagcagcaggaacagctgttggtggtaaaacaggtttgactgcggtcgttgttggcgtgttgttcttattaatgcttttcttccaaccactcgcatttttagttccaggttatgctactgcccctgcattaatgtacgttggtttattaatgttgagcaatgtgtctaaattagactttgatgactttatcggtgcaatgtcaggcttagtttgtgctgtgtttattgttttaactgcaaatatcgtaacaggtattatgttaggttttgcaaccttagtgattggacgtaccatttcaggcgaatttaacaaattgaacgttggtacagtagctattgctattgcattagttgcattctatgcctttggttttgcaatttaagtcctcaataaagatattttcctctttttaagaaaaatatttaacagaaatagctcattgtatgaaagataggatactaaatttatcccaacatcatccttagatactagaatgaaatagaaagtcaaacgcctataaatagaatctattcataggcgtttttatcacactacatttatcaatgtaatttctattattttactttttgtagcttatggtatgcatctagtaatttttgatgagctgacatattcctcaaagtttcatcagaaccaattaaaccatggaacggattttctccctgcattatattccaaacaaaatctacagcatctttcccatacattctgttaaatatcattctatactgctcaggttccctatcctcatccaaaaataattcaattacactaattaaacaacgatagtaattgtttctttctgctgaaaatacggaagcattcatattaactgtccaagttgcccaatctaatgcctcttcaagatttcctaaagccaaatgaagcatagattttaattcaccaatacgtaaagtttgtagtgcgcttcctttttcagctaccactccaataaattcacgtacccgtgtcatatcatcaataccttgctcatccagcacgtccaatagctcttgataaatttctttctcatgatggaaatagggtaaatcaagcaacatttcacgccattccattcccatattattattcgcatagatcaaatcgtcaggaggataaatattagacattccaggagcaattatacggcaagcgtatacacctaaatgttcatagtccataatataaacctcttgtttatactggctgaaaatttccatcaaattagcaaattcctgctctgttgtgcctgaaaaatcccagtgagtaaatttataatctggttctgatttaaaaagatcccatgaaatctgaccacttgaatcaataaaatgagtttccaaattcgcataatctgccacatcatcattattaaatgatggtggagaaaacacatccaaatcttttaaactacgcccctgcaaaagctcagttaccgtacgctcaaatgcgacttggaaattaggatgagcaccaaaagaagcaaaacacgtaccattcctaggattaagtaaaactacacagataactggaaattcgccacctaatgaagcatcatagcagaggatcggaaacccttcttgctccaattgctcaatcgaacgtttaatcgtcggataaccatcaataatacactgcggaatttcaggcaagctgattgcttcagtgataatacgatttttgataaagcgttcaaatacttccgatagtccctgcactctggcttcattcttagtattgccagctgacatcccgttagatacaaataaatttccaataatgctttgtggaatatataccgtatgaccatcagactgacgaatataaggtaatgcaactattcctcgttctgaattgctagactgtagatctaccagaaattctggtgtcaattctccatttggattaaaatagtcgtgtagaaatggatccaatattccttcaggtaattccgtttcattttcaataggaaaccatttttcatttggatagtgaacaaattcaccttcagcaatttcccttcctaaataaaaatcagcccaaaaataattagtcgataaacgctcaaaatactcccccaatgcggaagcaagagctgctttcttacttgctcctttaccatttgaaaaacattgtggacaatcaacatcacgaatatgtactgaccatacatttggtacaggattaagccaagaagcctcctcaatattaaatcctaattctttcaacttagtctggaatctttcgatgctttcttcaagggctgcatctttccccacaataaaggttttttctatcattttttctcttaaaatgaaacggttttactctatttatataggatgtagacattggaaaccaataaagaaattcataacaacatcttaaatctcttctaccagttagaataaattgagcggaaaatttccgcccaattcatatgttaaaaatccattaattctttctctttgtctgctaaaatctcatccacttttttgatataaatatctgtaatcttttggatatcatcttgagctttacgctcatcattctcactaatctgtttttctttctctaaagttttaattttatcatttgcatcacggcgaatatttctaattgaaactttaccttgttctccctcaccttttacaattttaattaaatctcgacgacgttcttccgttaatggaggaagaggaacacgaatagtagttccagccgaagaaggatttaaccctaaatccgaagttaaaatcgccttttctaccgcactaatcaacgaacgatcaaatacagtgactgctaatgtacgagcatcttctgcgacaacattagctaattgacgtaatggtgttgcggacccgtaatattccacttgaatagcatctaataaactaggctgagctctacctgtacggattttagaaatatgtccttttaaggcctcaaggcttttttccattcgttcttgagtatctttcttaatttcattaatcatagtattttcctttgattgaataacataaacctattgattttacccaatttcattctattttcctagtactaagtttatagggtttgtggtagacttatttgacttaactcatcacaagagggaatccttatgtaccaacaacaaattttaatagaattacaagaagcgcaacaagtattaaatgactttattaatgaccaacataatcttaaactaattcaagaagcagctttactgattactgatagttttaagaacgggggaaaaatactttcctgtgggaatggtggctcacactgtgatgctatgcattttgctgaagagttaactgggcgttatcgtgaaaatagaccaggatatccagccatagcaatctcagatccaagccatttaagctgcgtaagcaatgactttggatatgaatatgtcttttctcgttatgttgaggcaatcggacaaaaaggagatatcttgttttgcttatcaacatcaggaaattctaaaaatgttattaatgcaatcatagctgcaaaagccaaaggaatgaaaattattgcaatgacaggcaaggatggaggaaaaatagcagaactagctgatattgagattcgtgtacctcattttcgttatgctgatcgtattcaagagatacatattaaagtaatccatattctcatgatgttaattgaatttgaaatggcaaagtaaagaataaaaaatccaacttaaataaatagttaagttggattaattcgttgaatagcgttaattaagcaatcgtcgtaccttccgttgtacccgtcacaacttgtttcaacgcaccggctttacccatattaaatacacgaattggcatattatggtcacgggcaagagtaaatgcggctaagtccatcacttgcaattctttttcaatcacttcagcatagcttaaatgttgataaagttttgcatctggatttttcgcaggatcgcaatcatacacgccatcgactttggttgcttttaatacaacatcagcttcaatttcaataccacgcaaacaagccgcagaatctgttgtaaagaatgggcttcctgtacctgctgagaaaatcacgacacgtttttcgcgtaacattttaatggcttcagaccagttgtaagtatcacaaataccgtttaactggaatgcagacattaattttgcattgacatcagcacggtgtaaggcatcacgcattgctaaaccgttcattacggttgcaagcatacccatatggtcgccgacaacacggttcatacccgctttagcaagtttagcaccacggaataagttaccgcccccaagaactacgccgacttctacgcccattgcaagcaattctttgatctctaatgccattctatctaagatagatgggtcaataccaaaaccttcttcaccttgtaatgcttcaccacttaactttaacaaaatacgtttataaataggattgctcattttgacctctgtgtaacggttggggaaaaaaatcgaaatattatagattatcttaagaacagatcaaagtaggcaagcggatagaatttccactttattttcggtaaaatcgctatccctttattttcgttttgctcataatgaatataacaaagatactcgctactctcattagttttggtttatcttatttagcaagttacctaatgttacttggctcaggcttttttcctactcctgaaatcagcaatgtgctactgctggttctcgttattttatttgctaatgcctctaaaaaagcgttcttttatctgcttttgccgattgtcactttatacgccctttacacgccagttggcttgacctttggcccaccatcgtaccaatacgttgcttcggtttttgccacagatatacaagaaagcaaagagtttttcagccaaatccccctgattaactttgttgcttgtactggcatttttatatcactgttaggttttcgttttattagccaaaaatggcaaattcagttccacaaaaataaaacctttcttgccttagggattgcattagtttttatctctactccgcccttcaaatttctacaagaaggaagtagtgcaattagtaaagtaaaagcagaattagaccgcttgaatagtatgtccattcaaagtgaatggggaacgtcgcaactcaatgcggaaagccgttacgatgattacattttagtgatcggcgaaagtgctagaaaagattatcaccacgcctatggctaccctgctgaaaatacgccgtttatgagcagtgccaacggcattttaattgatgggctgaccgctggtggaacaaataccattgcttcattaaaattaatgctcactaagcctgatactgaaaagtgggaaggggaatacagccttggtatgatcgatttgattaaatccgcaggaattaaaacctactggctatcaaactaaggttatcttggtacttttgatacacctgtttcctcccttgctaacaaaagtgacgaaaaattattcttaaaatcgtgggactctttccatcaaaatatcagtgactttgatttattgcctaaatttgaacacattattgagcaaaaaactcatagcaaacgttttgttgtggtgcatttatacggttcacaccccatcagctgtgatcgtttaactgattaccctaaaatgtttgatgatgaaaaaataggcaaaaagtatttcaacgtaaactgctatgcatcgtccatcaaaaaaaacgacgaagtgttaaaacgcttatatgaaacccttcgcaaaaatgagcaacaatctaaccgctcgttttcggtggtctattttgccgatcacggtttagctcaccatatcactgaaaatgacattgcaatccacaacagcagtggcaaaagtaagctacactttgatgttccgctctttaaaatatctagtgatgataccgatagaaaagtctataaagcgatgaaatctggcttaaactttaccgatggcattgcaaaatgggtgggaattagtaatccgaaattgaatacagaagtcgatttatttagtcctcattcagacaaggaagattatgggctaaaaaaattgattgatggttttgaagggaaagtggatcctgctgtggttattcctaaggatgagtaattctatatcccaaaatgattttctgacagcataagtgcccatagtaatacaataattaatttagccatttaaaaatctagacgtttagatgtctaaaatttcttgacgaaacgatttcctattcgtaaacttgaaaccattcaaagacaagcggtcgcttttttaccgttttttgcaaggatttttatggcacagcagattactctttttgatgatattccccttgagcttgctttaggcggaacactttcgcctatcaatgtcacttaccaaacctatggcacattgaatgcggaaaaaagcaatgctgtattgttgtgtcacgctttaacgggtgacgccgaaccctattatgcaccgcctgcggataaaggctggtggcaagattttatcggtgcaggattagcttttgataccgataaatacttttttatctgctcgaatgtgcttggcggttgcaaaggtacgacaggcccttcgtctatcaatccaaatacgaataaaccctacggcagtcaatttcccgttatcaccgtgcaagatattgtgaaggtgcaaaaagccttgatcgataaactcggtattactcggctacaagcggtcgtgggtggctcttttggtggaatgcaagcgacacagtgggcgattgattatccggaacaagtgaaaaatgtagtcaatctctgttcttcgcttaccttgagttcagaagcaatcggcttcaatcacgttatgcgacaagcggtaataaacgatccccattttaacaacggcgattattatggcagtacgcccccagataacggcttaaaaattgcccgaatgctcggtatgctcacctaccgcaccgatgtacaacttgccaaagcctttgggcgtgaagtgaaacagacgggaacgatttggggtgatcacttccaagtagaatcttatttaagttatcaagggctcaaatttctagatcgctttgacgctaatagttacttacgcctgttaagagccttagatctctatgatcctgctttaacctatgcaaacgagcaagaagcactcagtcgcattaaagcgaattacacccttgtcggcgtaacgagcgatcaactgtttaaacagattgacctacacaaaagcaaacaacgtttagaaaatgcaggcattgccgtcgatttttatgaatttcattccgactttggacacgatgcatttttagtggattatccgttttttgaagagatgattaagaaaggaatctccaagtaggtcgggcatttatgcccgacaagctcatcccttttatatctaaaaacatagaaattgtaggagatataatgcaataccgaagactttatcaaccaggagcacaatatttctttaccgtagtcacctatcaacgccgcccaatattaacaaacgctgatgtccttcacactcttaagaccgctataaaaagggtacaacaaaaatatccttttaaaattaacgcattagtaattttatccgatcatttacatactatttggcaattgcccgacaatgattcagacttttcaatgcgttggaatcaaataaagcgttatgtaagtcaccattgccaacattatgacaatatagaaaaaaccaacaatgaactaagaaagcgacaaagtagcatttggcaacaacgattttgggaacactgtataaaaaatgaagaagatgtcgaaaaacattttgactacattcactataatcctgtaaaacacggatacgtttcatcagtaactgattggaaatactcaacctttcacaaatacgttcatcaaggtatttatccaaaagattgggctggggttaatcaagattttgattatgagtagtgctatatttcgggatgtcgggcataaatgcccgacctacccttctaatttatttagttttgaatagcgctagatttcgagatgtcaggcaataaatgtccgacctacccttttaatctgtttggtaaaacagactgaaacagctctctgcttttcagcggtgctgatcccaaataaggctttaaagcaatacgggtgaaacgttttgccgattgtaaggtttctttctctgaaaaatccatttccgcaaaagctaataaatccttgccgataaaggtatagttattttgtaataaagaggcaataaagccttcattttctctaaattgatagctcatttttggatcgacaggcttacctgttgcggcacaatggcaaaaatccaccccataacctaacgctttaagtgtttgaaattcaaaagtgcgtaagatcggttcgatctcgtttggctggcttgccaactttgtcatacactgtagataatgctgaaacaattcagggtaagcggtatgattttccaaaactcttgcaaggacttcattgacataaaaaccgctatacagtgccagcgtttgcatcgggagggttaaagatgcaggttcagctttggtaagtgttttgagatcgcctttgctcgtccatttcagcagtaaaggggtaaagggctggagaatggatttcaatggcgaacgtggtcgtcttgcccctttggcaagtaaggtaattcgcccgtgattttcagtaaaaaaatcaacgagcaaactgctttcactgtactctctgcgatgtagcacaaagccacgttgccactgttcgatcattattcgtcaatatagcccaaacttcttaacgcacgttcatcgtcagcccagccggctttgactttcacccacagctcaaggtggaccttattatcaaacaagcgttccatatccgcacgagcttcagtgccgatcactttgatcttctgacctttgttgccgatcaccatttttttctgcccttcacgttccactaaaatcaaaccattgatttcgtaagtgccacgctcgttagttttaaactgctcaatttcgaccgttacagagtaaggcaactcttcacccataaaacgcattaatttttcacggataatttctgacgccataaaacgttgcgaacggtcggtgacataatcttcaggatagtgatgaatgccttcttttagtgactcacgcacaaatttctctaaaatatgtacgtttttgccccgttgagctgaaatcggaatgatctctttaaacgggaatttctgcgataaagcggtcagatgtggcaataattcttctttttccttgatattatccactttgttaatcgctaaaatcacaggggctttggtcgagcgcaatttattgagtaccatctcatcatcatcggtccacttcgtgccttctaccacaaaaatcaccatatcgacatcaccaatcgcactggctgccgcacggttcatcaagcggttaatcgctcgtttttcttcaatgtgaagccctggggtatcaacataaatctcttgatacgccccttcggttttaatccctaaaatgcggtgacgtgtcgtctgagctttgcgagatgtaatcgaaattttctgtcctaaaattttgtttaatagcgttgatttccctacgtttgggcgaccaacaatggcaataaagccgcaatatgttttttgatctgtcattgtgttctcttaaataaatacaaattgaaatggtgggtcaagagccaccttgcattaggctattttattcccaacacctttatcacctgcaatgccgcatcttgctcggctttgcgacggcttgtgccgttaccgataaagatttcatcaactttttcgactttacaactgactttaaaagtttgattatgggcttcgcctttaatatcaatcacttcgtaagttggtaagggtagcttacgcccttgtagatactcttgcagacgagttttcggatctttttgtgcttcccctagttgcatgtcatttagaagttgctgataccaacaatgcacacgttccatcgcccgatcaatcccagcatctaaatataccgcggcaataatcgcttccacacaatcggataaaatagactctcggcgatagccaccactttttaattctccagcccctaatttcatatattcgcctaactcaaactgacgagcgacaaccgcaagggtctgttctttcaccaatgccgcacgcatacggcttaattccccttcattcgcttttgggaatttttcatatagggctttaccaatggcaaaatttaagatggaatcgccaagaaactcaaggcgttcattatttttggaagcagcactacggtgagtgagggcttgggtgaggtaatcaaggttagcaaattgataacctaattttttctgtaatcgttctagttgcattttagtttatcttcgtggaatacccccctttgaaaaggggggctaggggggattttgctaacattgaataaaattcaccctttaaaaatcccccttaatccccctttttcaaagggggaaatgttctctttatttaatcgccgtaaacattctctcaaaacgtaatccgcttggaaattcattcggtttcttatcaaggcttaaccaaataacacttgctttaccgaccatattcttttcagggacaaacccccaaaaacggctgtcttcgctgttatcacggttatctcccattacaaaataatgcccttctggcactacccattccccagcaggaataccgtcttgtttgaagaaataaggctcgtagttaaaagcgtgcggattatttaaaatttggtgggtaacatcaccaatttcagtgcgttcaacttgcatttcaccgtggtagaaaaagtcaggatttggtgcactgccttcgtatttaaacaccacttctttgcctgaatcgccgtgaacaacggttaaattacgggtatggaaatcatatttcacacggtcgccaccaacacccacaacacgcttaatataatcaacgtgtggctgttttggagctttaaataccacaatatccccacgttcaggcttacccatcggaacaagcgtattttgccaaatcgggtctttaattccataagtaaatttattcactaacagaaaatcacccacgcgtaatgttggctccattgaaccgcttggaatttggaacggctcaaaaataaatgaacgtaaaatagtgactaatgctaacaccccaaatagtgacgcaaaaaaatcccccactaatgaacgaggttgaattgtggctttttcttctgctgagagcggtttgcctaaacgcttttcttcacgctcaatcgcacgcaagcggcgaggttcagcactaaatttgtaaaatgaccaaaagccaccacaaataacaactaaacctactaatataatggaaatcgtgtttggtagctgcattgagtccaacactttccaaacaccgtacaatactgcaataaaaccaatggttaaaatattgctcatctgttttttcttctccttaatctaattgctccccctgcttgcggggggagctgccgaaggctgaggggggattattagtccttcccaacgtgcaaaatcgctaagaacgcttcttgtggcacttccacgttacctaaagatttcatacgttttttaccttctttctgcttctgcaacagttttttcttacgacttacgtcaccaccgtaacattttgccaatacgtttttacgcaactgcttcaccgtcgaacgagcgataatatggttaccaatcgccgcttggatcgcaatatcaaactgctgacgtggaattaactctttcattttttccactaactcacgaccacgataaggggcattggctttgtggacgattaacgctaacgcatcgacacgctcgccgttgatcataatatctacacgcaccatatctgccgcttggaaacgtttgaaaccataatccaacgacgcataaccacgcgaagtcgattttaagcggtcgaagaaatctaacaccacttcacccatcgggatttcataagtcaatgcgatttggttaccgtggtaaaccatattcgtctgtacaccacgcttctccacacataaggtaatcacattacctaaaaactcttgtggtacaagcatattacattctgcaatcggctcacgaatttccgcaatatggttaatcgcaggcaacttcgacgggctatctacatagacaatttcgccattcgtttgttccacttcatagactaccgtcggtgctgtggtaatgagatccaaatcatactcacgttctaaacgctcttgaatgatctccatatgcaacaagcctaagaagccacagcggaagccaaagcctaatgccgttgagttttctggctcatagaaaagcgacgcatcatttaagctcaattttgccaatgcatcacgaaacgcttcataatcatctgagctaatcgggaataaacctgcataaacttgcggttttacttttttaaagcctggtagcacttcgcttgcaggattgtgatgatgggttaaagtatccccaacaggtgcgcctaaaatatctttaatcgcacaaaccacccaacctacttcgcctgttttcaattccgtagtatcaacttgttttggcgtgaaaataccaagacgatctacttgataagattgtcctgtactcatcactttgattttattgccttttttcaacaccccatttttgacacgcacaagggaaaccacgcctaaatagttatcgaaccacgagtcaataatcaaggcttgcaacggtgcatcaggatcgccttcaggggctggaattttcgccacgatttcttctaaaacgagatcgatacccacgccagtttttgctgagcaacgcaccgcttccatcgcatcgatcccgacaatatcttcaatctcttctgcaacacgctcaggatccgccgcaggcaagtcaattttgtttaaaatcggcaccacttccaaatccatctcaattgccgtgtaacagttagcaagagtttgtgcttccaccccttgtccagcatcaacaaccaacaacgccccttcacaggcggctagggaacgagaaacttcataagagaagtcaacgtgtcctggcgtatcgataaagtttaactgataggtttgaccatcttttgcttgataatttaaggtaacactttgtgctttaatggtaataccgcgctcacgctcaagatccatagagtctaacacttgagcttccatttcacgatctgacaaaccgccgcaagtttggatcaagcggtcagataaagtcgatttaccgtggtcaatatgagcaataatagaaaagttacgaatgttctgcattttcataagggcagtaaatgtcctattgtattgttattgataaaagaaaaataatcggcggattgtacctgaaaattacaggaaagggaaaaggaaaggagaatattagaatgaaaatttataaaatagagaaaaatctagacctagtaaacgactatagccttcaatataaggctatagtcaattttatagcagctatttttctgcttatctaaaatacttgactgatgtagttaagtcttttactagtgtttaactattaaaagtatacaagaattctagttatttttctcatcagacatacttaccgctgcggtaaataatacgtccgttgatgagttaagtgctgtttcagctgagtcttggataacaccaatgatgaaacctacgccgataacttgtgctgcaacatcgtttggaatgttgaacaagctacatgcaagtgggattaataataatgaaccaccagccacaccagatgcaccacaagcacagattgaagcaacaatacttaataataccgctgttgagaaatccggcacgataccttgggtgtaagctgctgctaaggttaatacggtgatagtaatcgctgcacccgccatattgatgttagcaccaagtgggattgcgatagagtaaatttcttctttgatgcctaaacgttttgctaatcccatatttacagggatatttgccgctgagctacgagtaaagaatgctgtcacaccactttcgcgtaaacaggtgatggtgagtgggtatgggttgcggcggattttccagaacactagtagcgggttaagaatgaatgccacaatcgccattgcacctaataatactgctaatagacgagcatagccgataaaagcatcagcaccgttagttgccattgtttctgccactaagccaaataccccgattggtgcaaatgcaataaccacttttaccacgaaagataccgcatcagagaagtcatttaataaaactttggtgcttggtgctgcatgacgtaatgcgatacctaagccgatagaccacgcaagaataccgatgaaattaccgttagtaattgcaccaagtgggttatcgactaagttgaaaacaacggttttcaatacttcaccaatgccttgcggtggtgcaagtccatctgggcttgtgaccaattcaagggtcgttgggaataaatagcttaaagtaaccgctgttactgctgcaacaaaggtacctaagccatacatcaccaaaatagattttaagcggctatcgctgccgacttctttgttagcaattgaagccattacaagaacaaaaactaaaatcggtgcaattgcacgtagtgattttacaaagaattgtccgagaaccccaacgcttttggctgcatctgggctaactaatgctaagcagatacctagcactaaacctacggcaatgcgtaatactaaattaccgccaaggatttttgaagataaagattggttactcataaaatttcctgtaagacaaataaaaaagacttcatttaccaaggtaaatgaagtctgcgagattagccgaaaatgtagaataagggaatagcaagcggcaatttttctgcaaaaatttttaaaaattagaattttaagaaaaaacaccttaaaaatttaataaaaatctccgagaaatgataataactattaaataaacacctgttctgtcacttgataaccttgcggaacctctgctttatcatcaaaggttacaaattcccaagcattttcattcgctagtacagctcgtaataatttattatttaagccgtgacctgatttataggctttgaaatcacctaaaatattgtagccacacataaataaatcaccgacagcatctaacattttatgacgaactagttcatctttaaaacgtagcccttcctcattcaaaatgcggtattcatctaaaacaatagcattatctaaactaccgcctaatgcaagaccaatggattgaagatattcaacatctttcataaaggtaaaggttctagcacggcttaattgttgaataaaatgttgtgctgaaaattccattttgtagttacgcacttctttggtaatcattgggtgtgtaaagtcaatggtaaagtctaatttcaaaccgtgactataaggtttaaattcagcccacttatccccttcttctactcgtacactttctttaatacgaataaattttttcggcgcgtcttgttcttcaatacctgcatccaataagagatagataaaaggacttgagctaccgtccataattggaatttcggctgcatcaacttctacaattaggttatctaaacctaacgcagacattgctgcgtttaagtgttctactgttgaaatacgcacaccttcatcattgatcatacaagtacaaagttgtgtatcacggatagattcagcacttgccaggaaataaacgacaggcttaagatctgttcttgcgtaaataatccctgtatttgcaggtgctggacgcaacgttaaggttactttcttgccactgtgcaagccaatacctgttacttttgctgcttgtttaagggttctttgtttaatcatatcgtttccttatttcccgaaatggttattgaccatttctcataaacccagggattgagttcggcgaaaagacctgcgctgtatcaactttctgtggtcttggcgctgtttgctgaacctgttgtggttgctgagacatttgatgcgttgtatattggttttggtttgggtaaccgcccatattatttataaattcaggctgacgagcaccgccaaatccgttattaataatagattgttgcggaatatcggttcttccttgcacacttggaatttttggcatttcttctggttgtccgatacctgtagcaaccaatgttacacggatcttaccatccatttctggatagaatgcagaaccaaaaataatagctgcatcaggatctgcgaagctagtaacatattccataatggtattgacttctgcaagttcaatatcatagccagaagaaatattcacaagaatgcctttagcacctgataaatcaacatcttccaatagcgggcttgctacagcttcttttgctgcattttctgcacggttttcaccctctgcaatgcctgttcccatcattgctctacccatttccgacatcacttttttcacgtctgcaaagtcaacgttcacaagaccttcggaagtaatcatatccgtaatacctaataccgcattgcgtaagacgtcatttgcaacgccaaaggcttcattaaattttacacttttaggtaatacttttagtaatttatcattttggataatgatgagtgaatccacatgttttgcaagttcacggatcccttgttccgcatagttagaacgttttctaccttcaaaagagaaaggtttagtaacaataccaactgttaatgctccttggcttttagcaatttcagcaattacaggagctgcaccagtacctgtgccaccacccataccaacagcaatgaagaccatatcagcacctgtaagcatattcgttaatgcttctctatcttcttcagctgcttgatgaccaatgtttggatctgctcctgcccctaagccttttgttacacttgcacctatttgaatcgtattgcgaacggcactactacgtaatacttgtgcatccgtattaaccgaaaagaattcaacactaccaacatcagattggttactaaccatatgatttagtgcgttaccaccaccgccaccgacaccgataactttgataaccgcatcttgcgttgcttcataaataggttcaaacatttgtgattctccctcacggcttaatattgttattaatgcctattaaaaacttgattttatccaattatacgcttttttagcactatgacctaatgtatcaataatgccgcccaccttatgactaatttctccactttggctactatcaacgtcattataatgactatactgtagcaatcctaatacggttgcataagaaggtttgtttacataatccgttaatcctgtaatgttcaatggattaccaacccgaacttgtgatccaaagacagattttgcacattctacaatatcttcaacctgagagccaccacctgttaatacaattccagcaattaattcttgttttatgcctttttgatatagttcattgcgtaattgggataattcctgattaattacgctcagtaaatcgtggtagcattgagatgtaacattagataattggctttttgtaaaagttcttggcattcgtccacccaagcctgccacctcaatttttttctctggaaaatgagttgggggtgcaatagcacatccatactgtactttaatattttctgcatcttggcgagaggttgtgaaaacatgagcaatatagtccgttacattattcccaccaaaaggaataactttactaaaacgcaaagcaccatctgtataaacaagaacatccatagtgccaccgccaatatcaattaaacaaaccccaagttctttttcatcttctgttaacacagaataacttgaagcaagccccgaaaaaacgatttgatcaatttttaatttacttctctccactgcattttttaaattacgtagccaatcgttatggcaagcaattaaatgagcttgagcctgcaaacgcataccagataaaccaaggggatttttagtagcaggtaatctatctactctatattcctgaggaatgatgtgtaatgtttccagcccatcgggtaatttaatagaacgagcaatatgaatagcattatccaaatcttcatttcttacactaccagacaacggcacagttccactttcattaaaagctgtaatgtgagatcctgaaagggcaagagtaacacatacaatatcatatccagaaatcgattcagcttcttcaatcgcacgttgaatagcacttgttacagcatctaaatcaacaacgccaccaccttgaacacctttagacgggctaattccagagccaatcacattaatcaccccatcaggcaatacctcacctaccacagcaactatcttgtgtgttccaatttctaaacctactctaattctagattctgctacttttgtcatattaattatgtttgcaagttaataaattattgattattaaatccaacggaagccccgtgttcataacgtaaatctacgtaggataaacgtttcccctcaggaatatcaatttcaggaaaaatagtcacaaaacgatcgattttgggtagccattcccctcgccctaattttagttcaacgccattatcaagtcgaattgaccaagctcctcgactatccattgcaatggaatataatcctaaattacgtgattttaaatctgcttttattttatcccaagcctcaagcacaaccttactttctgtgtctggtccgtataaaataggtaagcctgtgttatcaaacctatctttcggcaaactgaacactactccatgttcagaaacatactgactattattccatacagccattggacgatgttcaagtaacgtaatacttaatttatcgggataaacttttctcacagaaacattactgatccaaggaattgttagaaatttctctttaatttcttgaatatcctgttcaaaatagccttttaacaagggttctttagctaaaacttcacgaatatcattattcgtcgtaaattgtgttttatgcgttaatgcataagaacggattggcgttctatccagtgatgcaagcaaactagaccaattggtataaattgcataaaccataccgaaacataataacacaacgataggcttaacaaaaacaaaccaattaatcggatatttcggcttacttgcttgtgtacgaattaccgaagtcggtttcttacgtattaccgcaaccattacgcacttaactccaatacacgctcaactaaacgctcgaaactataacccacagtcgccgctgattttgggaaaatactatgactggtcatacctgggcaagtattcacttcaactaaacggaagtttccttcgccatcttccattacatcaattcggctccaaccacgacagcccaccacatcataagcctgtttcactaacttagcgacttccgcttggcgatcagcatttaacgctggcacaacatactgggtattatccgaaatatattttgcgtggtagtcataaaactcgccgtctggaataatttgcaccgcaggcaacacttcaccatcaagtactggcacagagtattccgcccctgctaaattttcttccaccaacacaattgaatcatattttaatgcttcttcgattgcaggtaataactgttctgcggttttcactttgcttacgccaacacttgagccttcactcgcaggtttcacaaataatggtaaacctaattttgcaataatttcatcggagttgaccgcttgcccacggcgtaccacttccattgccgctgttggtaagcccactgcattccacaatagcttggtgcggaacttatctaaagtaatcgccgaagccattacgccacagcctgtatagggaataccgagttgctctaacgccccttgaagcacgccattttcaccaataccaccgtgaagaatattaaatacacgctgaatgcctttttcttttaatttttcaatcggaaattcttttgtatcaatcgcttcaacgttataacctaaactttgtaatgcttcaaacaccgatttgcctgaattgagcgaaatttcacgttctgctgaaacgccaccaaataacaccgcaattttttcgttttttaagctcattatttttaccttatttatgttttacaagcggtcatttattgcaagaattttacattattatggggaattgtagggacacactgcgtgtgtccgcaaaataaaccatatcccattttaacaacggacacacagtgtgtccctacagttaattcattgaaattattgcaaattttcggatttaccgtaggagagaattacattcgccctgatgttactatgattatttggggcaaatgtgatttgcccctacacattattttgtacaattacacaatagcgaaaatttctcgaaatcttatcgcttgttttaaatcttctttatgccttccaactttccgctaaatcacgcgaaagcttgctcacgttgcccgcaccttgtgccaaaattaaatcaccatcttgaataatttgatctaacacttcgccaagttgtgaagtatctgacactaaaatcggatcaactttgccaagattacggattgaacgacacagatctttactctctgcccccacaatcggtgcttcacctgcggcataaacattgagcataatcaatgcatcaacctgcgacagcacttgcacgaaatcgtcgaataaatcacgggtacgagaatagcggtgcggttggaataccattaccacacgtttattttcccagccttggcgagcggctttaatcgtcacatctacttccgttgggtgatgtccgtagtcatcgactaacatcaccttaccatttggacgaataaacgaacccaactggtcaaagcgacgacctgcaccttggaaatctgcaagagcagccaaaatcgcctcattcgcaataccttcttcttttgcaaccgctaatgctgccgttgcattcagtgcattgtgtctacccggcacgtttagtaagatctcaatacgctcacccgttgggcaaaccaccgtataatgcccttggaagcctgtttgttgataatcttcaatacggtaatcggctttttcactaaaaccatagctaatcacttggcgaccaacttttggggcaatttccatcactgtttcatcatcagcacacatcactactaaaccgtagaatggtaagttgcgtaagaaacgtacataggtttctttcattttctcgaaatcgccaccgtaagtatccatatggtctggttcaatgttggtcacaacagaaaccatcggctgtaaatgtaagaatgacgcatcactttcatcggcttctgcaattaagtaacggcttgcacctaaatgagcatttttacccgctgattttactaaaccaccatttacaaaagtaggatctaatcctgcttccgtataaatcattgaaatcattgcggttgtggtcgttttaccgtgagttcctgcaatcgcaataccgtgacggaaacgcataatttctgctaacatctgcgcacgttgaatcacaggaatacgtgcttcttttgcagccgcaacttcgggattgctttcattaattgcactggaagccacaacaacacttgccccttcaatgttttcagcttgatgtccgataaaaacttttgcacctgcttttgctaagcgttgcgtgactgcaccatcagcaatatccgagcccgaaatttgataaccttcatttaataatacttcagcaatcccagacatacctgcgccaccaatcccaataaagtggatttgatttacacggcgcatttcagcgactaattttttaactttatcttggaaatttttcatttttattccttatattcgatcattttgcaaaaaaactacaaaatctgaccgcttacaaactattttccacaatcacttctgccactcgttttgcggctaatggtgtggctttcgctcttgcttttattgccatttccgtcagtttttgacggtcggcaattaacggctctaatgcttttaataaactttcaggggtaaaatcctgctgttcaataatcattgcagcacctacttgtgcaaggtactctgcatttaaaaattgttggcgatctttatgttgaaacggcacaaaaatcgcaggcaatcctgctgcagcaatctcgcatacagttaaagcaccagaacggcaaatcaccaaatccgcccattcataagcggctttcatatcatcaataaattcgctagcaatgccgttacctgttgcttgataaacttcttccacaccggctaatttgcctttgccgacttgatgactaataaatacgttttgtcctaacactttcgctacttccagcacggttttattgatcaccaatgccccctgactaccgcccatcactaagatattgatcggatagcctttttcagcaaaacgttgttcaggcggtgcaatttcaaatagatcttggcgaacaggatttcccaccacttccgcatttggaaacgccgttggaaatgcttgtaaagtacgtcgagcaattttagaaagccatacattcgttaaacctaccaccgcattttgttcgtgcaaaatcacaggcacaccacataatttcgctgcaataccgccaggtccggatacataaccgcccattccgagtactgcatcgggcttgtacgcgttaataatttttttcgcttgaagtaccgcccttaagatcgcaaaaggggcagtaagtaatgctttgatccctttgccctttaatcctgaaatttgaataaactcaatcggaataccgtgttttggcacaagatctgcttccatacgatctttggtaccaagccaacggatttcccagccttgttgttgtaattctcttaccacagcaatcgccgggaaaacatgtccgccagttccgccagccattaccaataatttttttgtcatattattttccaatattaatcatcgctgaaatgtgcatgaccaattcgatccaagcggttttcgtaatcaatccgaattaataccgcaattgcaatcgccataatcactaaacttgaaccaccatagcttaccaatgggaaagttaagcccttggtcggcagtaaccccgaagcaacaccaaggtttacaaagccttgaataaaaatccaaattgcaataccaaaagcaaaaaaacctttaaatcgctcttctaacattaacgcttcccgactaacctttaaagctctaaaagttaaagcgagtaataatagcacaacgacaacaattccaactaatccaaactcctcagcaataacagccattacaaagtcagtgtgtgcttcgggtaaatattctaatttttgtacggagttacccaagcctcgtccccaaatctcaccttgcccgaaagccatttgtgagttagatagttggaaaccatcgccataagcatcagcaaaaggatccataaaagaagttacgcgttttaagcgatattccgatgttaaaactaatagagcaaagactacaacgcctgtgataccaagaaaaataaactgtaagactttcgcccccataataaaaagcattgcaaatgtcagcacaaaaagcaccgctatacttcccaaatcaggttgagccagcaacaagcagctaaataaaatcaggattaccatagggcgaatgaaactaatgcttttttgtcgtatttcatcaaattttcttacatagaagctcgcaaagtaacaaatcaccgcaaattttgctaattctgcaggctggaaattaataggaccgatagggatccagcgtgttgctccatttactgtttttccaacaaacaatgtaattgcaagcagaagcaaggctgaaataaataaccaaccattatacttttcccaatatttacttggaatttgaacaaagaaagcacaagcacaaatagatgcgataacataaaaaccatctcgcaccgcaaaatagaagggatcttcgtgtagccgactactcacaggaatagaggctgaagtcaccataacaaatccaatgatcagcaatgcgagaaataaccacaccaatgttcgatcatagagtgcattaacaggcgttaatcttgtccacttatcccactcaatccgaattttttctagcattagataaccccttgagccaacgccacaaactgtctgccacgctcttcaaaatttttaaactgatctaaacttgcacaagctggtgaaagtagcaccatatcgcccgcttttaatcttaaacgaatttgtgcgacagcttgtgccattgtttccactaaaacgctattttgagttaaagcggcgagttccgccccatcttttccgaagcagtaacagactgtatttggttgattaataaaaggttttaactcagaaaaatcagcatcttttccgtcaccgcccaacaacagataaagcgttccttcgacttgcaaaccatttaatgccgccacagtactgccgacattcgtggcttttgagtcgttaatccagcgtacgccatcattcgtcggtactagctggaaacggtgatctaatcctgaatagctttgtagcgctttcacaatacccgaacgatcaacgcctgcagcttccgccaatgacattgatgctaaggcattcatcacattgtggcgaccagtaattttcagctcatcaatcgcaatgacggcttcatcgccagaatagagttctccattacaagcggtatattctgcgtctttttctgcaaattttttcaaagatccgaccgcttgttcagggaaagtttgcggatcttcgccatttacaataatattttccgcattttgatagatacgcaattttgctgcacgatattcttcaacggagttattgtaacgatccatatgatcttcactgatatttaaaatggttgctgctttcgcttttaaggaataagtcgtttccaactggaagcttgataattccaatacataaagttcgtaatcgcttttcaataagctcaaggcaggcacgccgatgttaccgcccataccgactttgatacctgcttgttttgccatttccgttgtcaaagtcgttaccgtacttttaccatttgcccctgtaatcgcaataatcggtgcttttgcttcacggcagaacaactcaatatcgccaaccacctccacaccggcttgaatagcttgctgaatttccggtgtcgctaaggcaagccctgggctaatcacaattaaatcggaacttaataaccactcaaggtttaaactgcctgtgtgtagtggaatatccttcgacaacttatccgcccctgcaggatttgctcgggtatcaatcactcgcacttgagcctgtttgtccgcaaaaaattcgacacaagataagcctgttgtgcctaagccgataattgtgatagttttgccttgatattgattttgcattttgttgttctctagaaacggtattttcagatgtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttagcgttattggtttcggttttggtctttttctgatgggaaaaaccaatcacgaaattgcgtttagcaacatcaataccacaataaatcggagcgttcatcggtaacctgccttgtattcgggtttatatttcaactgttcggttttgctgatgaagttatccacgcctacgctacagaacgagttttagctctagggacacccaagctgtggataacgttatggtttatgttgctagtttactataattttaatatacaagggacacactgcgtgtgtccgctttattttcattattcctcgattggtaaaactgtaacggacacacgcagtgtgtccctacattaattaacgtaatttcaacgtcaccaatccaattaacaccaacattaaggtgataatccaaaaacgcacgataacacgtggttccggccagcctttaagttcaaagtggtggtggatcggtgccatacggaaaatacgtttttggcgaagtttgtacgatccaacttgtaaaatcaccgataaggcttcaaccacaaagacaccgcccatcaccactagtaataattcttggcgaactaatacggcaatcacccccaatgcaccgccaagtgacaatgaaccgacatcccccataaagacttgtgctgggtaagtgttaaaccataagaaacctaaacctgcccctgcaattgccgtacataaaatcactaattcactgctatatttgatataaggaatgtgcagatattgtgcaaaattatagttccccgttgcccacgcaattaatgcaaatgcccctgcgaccataatgatcggcacaattgccaagccatctaagccgtcggttaaattcactgcattactggttccgacaatcacaaaataggtgagaacaatatagaataagccaagctgtggcatcacatctttaaagaaaggaacaactaactgggtagcagcggtatctttaccaatcgcatacataccaaaagcagatactaaggcaatcaccgatagccaaaaatatttccaacgagcaatcaagccatcggtatttttacgggctattttccaataatcatctacaaaaccgacaaccccataaccaaataggataaatagcacaaaccagacataggggttacgcagatccgcccataacaacgtactcacaccgatagctaataaaatcataataccgcccatcgttggtgtaccccgttttttgtagtggctttcaggaccatcgtggcgaacttcctgtccgaatttgagaatttgtaaacggcgaatgaccgttggtccaatccacaagccgataattaacgctgtcaataacgccataatagaacggaaagtaatgtacgacaccacgttaaacacggtgttgtattgcaccagatattcagcaagccaaactaacataagctaatccttaaaaagaaacatcaaaagaacgacataaggaagcaattacttcttccattttttggctacgagagccttttgctaataatacaagcggttgatcttgttcgattttttgcaaaatgttcggaagcaaaaacgccgccattgctgttttatcattaaagtggtgagctgaattaccgctaatcacctcactctctttgccgaagctgaccactaaatcgagcttcgcctgtttaacgaaatcagcgacttcttggtgacaagctgggctgtctttgccaagttccgccatatcacccaccacaaaaatgcggaaagccggatactgttttaacactgataccgcagatttcattgagtccacattggcattgtaactgtcatcaataaacagtacattctctttaatttcaatcggatacaaacgccctttaaccgctgaacgctgttccaatccagctttaaccgcagttaaatctgccccgactgccattgcgagtgccgttgccgctaacgcattgctcacattatgttcgcctaaataaggcaagttgatctcaatttcgccctgtggcgtatgcaaggtaaaacgtgaaccattgaggtgcaactcaacattttccgcccaaaaatctgcatagctgtctttatcttcgcctgtgtaacagaacgattgcaactcgtgatcgccaatctctttctgccattctggatagtaatgagctaaattcacaatcgccttaccaccagctttcaagccacgataaatttcacctttagcttgagccacacctgccaacgagccaaatccttcaagatgagcagatgccacgttattcactaaacaggcatcaggttgtgcaatttcggtggtataagcaatttcgccgatgtggttcgcccccagttcaaccacggcaaatttatgctcaggggttaaacgtaataaggtcaatggtacacctaagtcattgtttaaattaccaaaggtataaagcacctgatcttcacaagcggtcactttttgcaaaatttttgcagtcatctctttgacggtggttttgcctgaagagcccgtaattgccacagtttttgggttaatttccgctttcagccattttgctaactgccctaatgccaagcgagtatcttccacaataatttgcggtacattcaccgccaattcacgctcaacgactaacgccacacagccttgttctatcgctttttccacataatcgtgagcatcaaatttttcgccttttaatgcaaaaaataagccgttttcaaccgcttgacgggtgtctgtactgatgttttcaacaacaacctcgccactaccaagtagtttaccctttagggtttgggcgagttgttgggtggtttgttttatcatttattatcttctttattgtagggacacactgcgtgtgtccgttaaaaaatagctccacgaaagatggcggacacatgcagtatgtccctacattctaccccaaaaacttcctcgcccactcttgatccgaaaagtgatatttcttcgtgccaataatttgataatcttcgtgtcctttaccagcaatcaaaatcacatcctttggctcggcttgggcgattgcttgttcaatcgcatattgacggatatgcatagactgcaccgcttttggcttgcggaaacctttcataatatcgttaaaaatcacatcaggatcttcggtgcgtggattatcatcagtcacaatcactctgtccgccaactgttcggcaatacgagccattagcggacgcttacctgtatcacggtcgccaccgcaaccaaacacacaccataactcgccttcacaatgtaaacgtgcggcatctaaggctttttctaaggcatcaggggtatgggcataatcaacaatcaccatcgggctttcttccgcattttctttgctgattaaacactccatacgtccgcatacaccgtttaacagcggtgcggtttcgactaatttttgcaaatcgtagcccaacgccaataaaccagcgaaagcggttaataagttgctggcattaaacgctccgattaaacggcttttaatttcgccattaccccagctactttcaaattcaatagttgcaccttgtagggtaaattgcaccgctttcgctttaatccaacgggcttgttgtggttggaactgactgtcggtgctgacggcaactgcttcaggcaattttgccaaccattcacgcccgatttcatcatcagcgttgatcacttgttgttttgatgaaagctcgccaaataagcggagcttcgcttgggcgtactcttccattgtgttgtgataatcaaggtgatcacggcttaagttagtgaaaatcgccaagtcaaagtctagcgcttcggcacgatattgagccaaaccgtgagaagagacttccattgcacagaaatccgcccctaattcgacaaagttcaccagattgtgttgaatttcaacggcagaacctgttgtattcaccgcttcttgcacttgcccatatagtccgttgccaatagtacccatcaccgcagatttaccgccaagcaagtttcgccattgtgaaaaaagctgtgccgtagtggttttgccgttagtgcctgtaatacccacaagggttaatttttctgacggattgccatagaacgctccagcaattgccgaaagttgtttcggtaaatttggtacttccagtacacaagcggtcgaatttgcaaatttttctgcaaatctcaccgcttgaacgtcatcgtccgcttcagctaaaactaaagaagcaccttgttcaatcgctttttcaataaattgacgaccatcgacttgatgtccttttaaggcaacaaatagatcacctttttcaacctgacggctgtccaaggtcattttgtttaattcttttaattcgccccaatggttaagttcagggaaaaaggaaagtaaagggttcattattgcctcttagtttatcgaatttgttttcatctctctcactgcactttttgtatcttcagtaagattatctggtttaatatttcttgcttttaaagtatgtcccataatgcttgagaacagtggggcagataccgcaccgccatagtaagctcccgcttttggttcattaattaagacaactaaagcaaatcttggatcgcttgcaggggcaattccagcagtataagcaatatgtttttcaacatattgacctttttctaatttgcgagcagtacccgttttaattgccacacgataaccgtcaacagcagctcttgcaccaccttcacctttagctgcaacactttccatcatctgaacaacatctttggtgattttttctggtagcacacgctcaccaattactggaggatccacttttgtaatcgaaagcggacgataaatcccaaaactgcctaatgttgcataagctcgggctaattgtaatggcgttacatttaaaccataaccatacgccattgtcgcacgttcaatgtccgcccagcgtttacgatcgccgtttgtaccacgttgttcaccaagccctaagcctgtatctttaccaaaaccgaccttgctataagtttcgactaatgcggttgatggcattcttaacgctaaacggcttacacctatgttactggatttttgtaagatccctgtaagtgtcaaactctctcttggcgctacgtctttaattgtatgtccattaaccacaaaagggcgtgtactaatgacttcacttggataagtcactttattttgtagcgctgtcaataccacgagtggttttactgttgaacctggttcaaaagtatcggtaatcactcggttacgcgctaattctgatttgaattctgcacggttatttgggttaaaagatggtgcatttgccatcgctaacacttcacccgtttgaatatccactaaaacagctgttcctgattctgccttattttcaattaccgcttttttgatttcacggtaaaccatcgattgcaattcttcatcaatactgagcatcacatcttgcggatcatattttttctcatcgcgaatatgttcaatcacattaccacgagcatctttacggataacctgtttaccgtttttaccaaccaacaagctatcaaagctacgttctattccttccgagccttgtttatcatcaacatcggtaaagccgattaattgggaaatttcttctgcaagaggataaaaacggcgagtttctgcttttaatacaagcccatcaatttttaatgctcgagcataatctcctatcacatctgattcgtgacgagaaatatataaaaaacgttgatttgctgaagcataaagtttatccatcattacgctgtatttcatatctaatgctttggctaactcttgcattttttggcgttcaagctgagcatactcattttccaaatgtaaaaacatagaatttggattattgcgtatgcgttgaattaatacgttgtaatctaatgcagttgcacgagcgagtaatgtccaataatcctcatttttattgtttaaaatcgctctaggatcatatttattttctttattctgtggtttttctttaataaaacgattcacactagcttcaattttactggctgaagcctccatttccatagccaaaactcgccataacgatttattacgacgaagtttagtatcaaaatattctttaggatcaatcgtaattgaatacatcggcacactaattgaaagcactcgcccatttctatctaaaattttcccccttgtaaaaggaagctcttttgtccgtaaagagcgatcatttgcttctttgattaaacgttctgaatcagtgacttgtaagaaaaaactttgaccgatcaaggcacagaccattacaccgataaacagataaacaaatccaaatcgggcaggcaaaaaactaggctggggtgaaatatctacctcttttaattcatctcccatcgtatttttatttctagggttatatttcactgattttttcatttttattccactaaaatgatttcttgttcttttttaactggttgtaatccaaatttttcagcaacagcttcgactaaaaacttctgactttttgaattttcttctaattgcaaatgaacatactgattttcaagcttctgttttacttgcaataattttccctgctctgctgttaataaacgtgtttggtgcgtaatccaaatcgttgcaacagcactaatcaccaccccaacaagtagcaataacgccactttattatggctagttaaatcgtctaaaatcacttgacgtaaaggatagcgttcactcgacattatcttttctccgcaactcttaacaccgcactgcgtgagcgtggattggcttcaatctccgcttcacttggcataatcgctttgccgacggtttttaaaggaatattcttatttaactcactttctaaaatcggcagacctttcggcaccgtctcgcctttgctctgcttacgcataaactgcttcaccattctgtcttctagagaatggaagctgataatagacaaacgcccttcaggtgcgagtacagttagggctgaatttaatgccttttctaattcatctaactcactattaatgtaaatacggattgcctgaaaagagcgagttgctgggtgtttatgcttatctttaaacggcacgacatctgcaataatttgtgccagttgcaaagtacgggaaattttttcagttgcagatttattgtaagaaacgaccgcttgtgcaatgcgtttggcaaaacgctcttcgccaaactcttttaacacccaagcgagatcatcaacagacacctgtgctaaccactccattgctgacaagcctttggtggtatccattcgcatatctaatggtccatcacgcataaaactaaaaccacgttctgcttcgtcaagttgtggggaagatacgccaagatcgagtaagataccgtcaattttgccgactaaattaagttcgtcacaaatatcaggaatggatgaaaaagcactgtgaacaatttgaaaacggggatcagtgatcgtgttcgcttctgcaatcgcacgcggatcacgatcaatcgcaatcaatctaccctgttcacccaatttgcttaaaataagacgtgaatgcccaccacgcccaaaagtaccgtcgatatagataccgtttgatttaatggctaaaccatcaactgcttcgtgtaataacaccgtaatatgtttgggtgagtcactcattttgattatccgttattgttataaagaaaggttctttaatgcctcacaatgaagcatttcttctgagctaccaattgcaagatcttcgctaatctgtttctgccattgttgatcttgccaaatttcaaatttatttaactgcccaaccaacataatctgctgttctaattgagcgtgctgacgcaaagtcgggctaagtaaaatccgtccagcagaatccatttcacattctgtcgcaaaaccttgcataacccgttgaatacgacgctgtgcaggatcgaagttagacagagcgagcaatttttgctcgacaatttcccattcgtgcaacggatacagtaataaacaaggctggcgaatatctacggtacaaacaaatgacccgtggtaactctccaaaagctcggcacgataacgggtcggaatagcgatccgccctttgctatcaatgctgattgaagttgctccacgaaacatttttttgctcacttaaccttagagattcggaaatttggaaaaaattccacaaaacaccactttttcccactttaattggagaattttatagttttcgtagattaggggcaagaaatttgtcagaaaaatacgaatatatttaattataaatagaattcattacccgcagcaaaaacaacaaacttctttacattgcctcaaaatcaagcaaacgaaaacatttgtaattgttgtaaaacacagtacatttacttgtaaacgtttttacaataggagagctttttaagcttatttacatgaaaaacagagttcggtggaatcatcaatttagacaaagttcgttctgacaaagtatatagcttaaatttaacgctatggaagcgcaattggtattggttaggagtaacacctagggctacaatttacctatcgtaagcaaaatagtaatttgccaacgctctattcctgtacggataaaaacgtcaatatcttagttgaaagccagttttaaattgtagggatagggactatccccttctatctctatttccttgcctttgaccaatctaacgaggaaacaagcgaaaatcccctcttacataacttttcttaaaattagctgttgtgcagctgctacacaacaccagataaaatcttatttaaaacaaattgatctcgtcgccctattcctttattccctaactttctctataatcctaatcctcttacgttctttaaaatctggtggaattatgaacccaatgttaaatatcgctattcgtgcagcacgaaaagcaggcaatattattgctaaaggctatgagcaagcgcctcaagacactcaagttgctcaaaaaggcgcaaatgactatgttaccgaaattgataaagcagcagaagcagccattattgaagtgatccgtaaatcgtatcctgatcatgctattgttggcgaagaatcaggcgttttagctggcacaaataacgatgtacaatgggtgattgatccattagatggcacaacaaactttgttaaacgcttgccacattttgcggtgtcgattgctattcgtgtgaatggtcgtactgaggtgggtgttgtatatgatcctattcgtaacgaattatttaccgctgtgcgtggcgaaggtacaaaattaaatgaatttcgtttacgcattaacagcgaacgccgtgatttacaaggcatagtgttagcaacaggtttcccgtttaaagtcgcaaaacatcgtactgctcacttaaatatgattgaagccttgatgaacaatggcgtagcagatttccgccgtactggttctgcagcattagatttagcttatgtggctgctggtcgtgttgatggttactttgaaatcggattaaaaccgtgggattgtgctgcaggcgatttaattgctcgtgaagcaggtgcgttagtgaccaactttgttggtggtacagattacttaaaatcaggtaatgtagtggcaggtagcggtcgtgttttaaaagaaattttaaacagtattcaaccgaccttaactgaagaactcaaagcctaataatagatttttttgatgggcagttgcccacccaacgattaaagataagcttatgcaaaagacctatccattgctcagtcaaatcaactcacctgatgatttgcgtttattaccaaaagataaacttcaacctctttgtgatgaactgcgtgcctatttgttagagtccgtcagtcaaacaagcggtcacttagcctctggattaggcgtggtcgaattgaccgttgccttgcattatgtttatcagaccccattcgatcaacttatctgggacgtaggacaccaagcctatccacataaaattttaacgggtcgccgtgaccaaatgcatactattcgtcaaaaagacggcttacacccattcccttggcgtgaagaaagtccttttgatgtattgagcgttggacactcttctacctctattagtgctggtttaggcattgccgttgccgcagaaaaagagaacgcagggcgtaaaacggtctgtgtgattggtgatggcgcaatcactgcaggtatggcatttgaagcgattaaccacgcaggttcaattcataccaatatgctggttatcttaaatgacaacgaaatgtccatctcagaaaatgtgggagcattaaataatcacttagctcgccttttcactggttcgctttatggtactttacgtgaagggggcaaaaaactgctctcaggcattccgtcgatcaaagagtttgtgcgaaaaacagaagaacacgttaagggctttgtttcgcctgttggcacaatgtttgaaacccttggctttaactatatcggcccgattgatgggcatgatattgaagagttagtatctacattaaagaacatgcgtaatatgtcaggaccacagttcttacatattaaaaccaaaaaaggcaaaggctataccccagcggaacaggaccctatcggcttccacggcgtaccgaaatttgaccacacaagcggtaagttaccacaaacaaaatccgcaccgacctattccaatatttttggcgactggctttgcgaaatggcagagcgtgatccgaaaattatcggcattactcctgcgatgcgtgaaggatcgggaatggttgagttttctaaacgcttcccacaacaatattttgatgtagcgattgccgaacagcacgccgtgacctttggggcagggcttgcgattgcaggttacaagcctgtggtggcgatttactctagcttcctacaacgtgcttatgaccaacttattcacgatgtggctattcaaaacttgcctgtcatttttgcaattgaccgtgctggtattgtgggagcagacgggcagacccatcaaggcgcatttgatttaagttttatgcgttgtgtcccaaatatgacgataatgtgtccaagtgatgaaaatgaaatgcgtcaaatgctttacactgcttacacaatgaacagccctgttgccgtgcgttatccgcgtggcaatgcacaaggcgttgagcttcaaccgatgcaaacccttgaaatcggcaaaggcaaagtgttaaaacaggggaaaaaggtcgctattctcaatttcggggcattattaaacgaggccaaacaagtggcagaaacccacaattacacgctggttgatatgcgttttgcaaaaccgctagatgaagccttgattgctgagcttgccgaccgccacgaattattagtcacccttgaagaaaatgcccttcaaggtggggctggtagtgcagtaaacgaatacttgcaacatatcggcaaaatcaaaccgctattaatgttgggcattcctgatttctttatcccacaagctacgcaagccgaatcctatgcggatttagggttagatgcgaaagggattgagcagaagattctatctatgaaatgagttaatttccaaatctcattaaaaagctaagatactaaacctaagttgcccattcttaggcatggcagacaaatgggcacagtagacaaactagttactaatgtttattttttctaaatattagcagcaaatttgtctattatccccattcttatgccataaatctatcttccacaatatcactattaggagatattacttcagctgctcttcaataatcccaccgcctaaacagacttcgccttgataaaatacggcggactgtcctggggtaacggcgatttgaggttcatcaaaaatcactcgaatggtttcgtcatcaagcggttggatttcacataaaatatccgcttggcggtagcgtgtttttactgtgcaacgtagtttttcacggatcggttggcgatctacccagtgaagttggcttgcaatcaggccgcttgaaagcaacgcagaattatcctgaccttgagcgacaattagcacattattcaccagatctttttccactacataccacgcattttcactcgcccctttgacaccaccaatacctaaacctttgcgttgtcctaaggtgtggtacattaagccatcgtgacgaccaatcacttgcccatcgacggttttaatctccccagcttgtgcaggtaaataacgagcaaggaaatctttgaatttacgttcgccgataaaacagatccccgtcgaatcttttttctttgctgtcgctaaacctaggtcttctgcaatagctcggacaatcggtttttcaatatcaccaacagggaaaaaactttgtgcaacttgttgctcgctcagagtgtagaggaaataactttgatctttgttgctatcaagtccacgcaataattttggctgttgatcaagcggtggacgacggacataatgccctgtggcaataaaatccgcccctaaatcctctgcagcatattctaaaaaggctttgaatttgatctctttgttacacaaaatatcagggtttggtgtacgtccagctttatattctgcaaggaaatgctcaaacacattatcccagtactctgcggcaaaattaattttatgtagcttgatactcagtttatcgcaaactgcctgtgcatcggctaaatctgccgctgctgtgcagtaatccgtgtcatcgtcttcttcccagttcttcataaacaagccttccacttggtagccttgttgttgaagaataaaggctgaaaccgaagaatctactcctcccgacattccgcagatcacttttttctttgcattttccgctaattgttcatcggtaagtgcaggaaaatgttgttggtaagtttttgatttcattattgttgttctgtccgttgataaaattgctgtcccactctgtcgatatgctgaataaaattttcgtgagccagttcgtgataaattgaaagatcaaacagataaggtaggctagagtcttctaaatctagcctgattttacccaatatgctctgattaagatttggtcctttaaaagttaagtcaatatcagaacctatccgataattaccctttgctcgagaaccataaataatcgcctgctcaatttcggggtatttcttgagaatatcagtaattaccctaatagattgttcatttaatccaaacttttctgccataattccatcattctcttttctaatgcaaggaaaaggggaagataaatgtgaacaattttttcaaattctttcaacaaaatttgagcatcataagtatgaactgtcatattacggctattcaacatttccatccaatgatgcccctcaaaaataagctcatattgaaaggctattcgagttacgtttctaggtccatttgcatctaaaagaccttgatatttcaaatagtcttgcattactttccaagcaagttcgtgagcgatttcaaaactttgaataatcccttttttgataatatcaagatcagtatctgcatacttttctacatcatcttttagataagcaacagcatgttgataattttcaaaacgctgtttccagcgaatatcttgttgctccatttttccttcctattgatgaaaaaattattttacttcgtaaaactgagcctctttcttggcaaatttttcttcatattcggctttagcagcttcatcgccagcttctaattttgcttttaaattatcacaaggctcatcgcagtcacagacttttttcattcctagtgcagaaataccgccacaactacctttaattgttttacctttgataataaagccgattgacatcataaatacaatggctacaaagaaagcaaaggtcagtaaaattgtttccattttttgtcctattatttttgattaattaatttttcaaaggcactcgacattttagtttcatatccgtcgccttttttgataattaagaaaattgctaaattttcacgttctgccacttccagtgctttttctgctcctaacacatataagcctgttgaaagtccatctgcagtcattgtggttggtgcaaatacagtaattgaggctaagttatggctaatcggacgtaacgcttttggatcgataatgtgagataggcgattaccctgttcatcttcaaaatagttgcggtaattacccgaagtcgccatacctaaattatgcaatggcacaacaatttgacttgatgttccttgagcaaattcaggtttttcaactgcaatacgccacggttgcccttttaaatttagcccttttccgcgtaattcaccgccgatctcaacaaggtaatgttgtacccctaattgctcaaggtaatccgctaatttatctacgccaaatcctttggcaattgctgaaagatcgagataaagctctggtactttttttgttaatgtggcttttgtagcattatcatctaagactaatttttcaataccaacccaagtggcacgttctgcaatttgttcttccgttggtgctttatttaggcgtttatctggtccaaatccccataaattaacgaaaggcccaacggtcacatctaacgtaccttctgtcactttatttagacgtaccgcttctttgaccactttggcaaaatcagaggcaatttcaaacggtttatctgcctctttcatttgattaaattggctaatttgagagtctttttgataggtggacatctcgttatttaccatttttaacaacgtatccatttgacgttgaacttcttctggtttaggtaaatttgttaagctaccatcatcaatatatttgatatggtaggttgttcccattgttttaccttcaaaggcaatttgttggggttctttattacaagcagaaagcattacagcgaaaaatgccgaaattgcccacattagtaacgttttgattttcatacatcctcccaaaacgaataattaaattaataatggaaaatagacaagggcgatttccttatctattttccattattggattgttaataccctacatagaattatagcataatctattagattcagtatgtggaaaatgctccatttgtaaaacacaatagatttttatgatataaaatttactatttagcagttttattcaccaaaatttttcggtaaaatttttaacatttcagtccaaatttctgcactacgctgacgactcattgctaaacattctaccgctttttcataatcattagtttcacaagcgcttcgaagtgcttgataaaatgcaaaacttaattgacgagagctaggattggagaaaaataaagatgccgtttttaaatagagatctttaaaactatttaaaatcaacccataaacaggcttattggcaataaaggtaaattcccgatatagcttatagtcaaattcagcataagcttgtgccgtgtcttgaagcgattcaagatcttttaaaagtgacgaagaagctaaatgatcagctttaattgccttgggaataaagtattctcccattctagtacgcaacgaaacaacatttgaaataatcgtaggtgtgatagactcatctaaatgaattaatgtactaatgatgtttggacccgctgtttcccaaatattatttactttggttggtttaccgtgttggatactcaaccaaccatcacgcgcaagacgctgtaaaacttctcttaacgttgtacgcgtaacaccaataatatctgcaagttcacgctctgcaggtaaatctgaaccagcaggaaagcggttactccaaatacttttgattaaatattcttcagcaagggctgctgggctttgggctcttaaaatgtctgattgattcattgatttatctcaaaaaatgaagaaatacttcaaataaataataaaaagtgtgatgtacttatcaaaaatgatattgccttccatataatggctcttgggctattatcgtttaatctaaactagattacaatccacaatcatttttacttttttagttaaatctatgaataatcttgacgctttttataaaaattttctcggtaacgcaccagaatggtataaggcttgcattattgccttcttaattatcaatccattgctctattttttcattagtccatttgttgctggttgggcattagtggctgaatttatttttacgttagcaatggcattaaaatgttatcctctacaaccaggtggtttacttgccattgaagctatcgttattggaatgacgagtgctgaacatatcaaaaaagaaatcctcgctaactttgaagttgtcttactgttgatctttatggtggcaggcatttactttatgaaacgcttgttactttatgcattcactaagctactgatttccatccattctaaaaaaatacttgcactcactttctgtttaagtgcggcattcttatctgcattcctcgatgctttaacggtaattgcggtgattattagtgttggaatgggattctataaagtttaccataaggtcgcatcaggtgggcttttggacgatgatgagtccgatgatgcttcaaatgataaattaattacaaacaaacaaattttagaacaatttcgtggtttcttgcgtagcttattaatgcacgctggagtaggtagtgcgttaggtggcgtgatgacaatggtcggtgaaccgcaaaatttaattattgctgctcaagctgattggggatttggggaatttttcttacgggtagctccaattagtatcattgtgcttgtatcaggtattgcaacctgttatctcgtagaaaaatacaaactttttggttatggtgaccgcttgccgcgtaaagtttgggtggtattagcccattataacttgcgtaaagaacaagagatgacaaaacgagaccgaatgaaattggttattcaagccatagcaggtgtttggttagtcattgcgttggcattgcatttagcggaagtaggattaatcggtctctctgttattattttctgtacagctttctgtggtatcactgatgaacacgccttaggacgttctttccaagagtcgctaccatttaccgcattgcttgtggctttcttctctatcgttgccgtgattgtagatttgaaactctttgatccaattattcaatttgttctgtccgctgaaccaagctcacaattggtgctgttctatacatttaatggattgctttcaatgatttcggataacgttttcgttggaaccgtttacattaacgaagcaaaagcggctttccaagctggcattattagtagggaacaatttgacctgattgctgtcgcaattaacacaggaaccaatttaccatcagttgctactccaaatggacaagctgcatttttattcttattgacttctgctattgcaccattaattcgtttatcctatggacgaatggtctatatggcattaccatataccgtagttttatcaggagtagggttctttgcattagaatttttactgccacaattaacaaaattaatgacggagtggggctggttaatcactcgttaaaaataaagggaaccgtatgctaacttattttaaagagctatcaataagtcgtagtgcttggctacttctcactgcaagctgtacagcactagaagctgctgcgctctattttcaacacggaatgggactaaacccttgcgtgatgtgtatttatgaacgattagctctattggcgattttaattgcggggattatcggctttttagccccccgcaaaacgctcgtacgttggcttgcattattacttggtttatttggctcaataaaaggtttaagccttgcaattaagcatacggattatcagctcaatcctgctccgtggaaccagtgttcaccttttgtagatttccctgaaacattgccattgaacaaatggttcccagatctctttgaagctacaggtaaaggcgattgtggaaaagtggtctggcaatttttagatctctctatgccacaatggttgattgtggttttctctatttatattgtcgtttttgctgttattattataagtcaattcaagcaaacttcttcatacagaacattatttcgttaggtgaaatatgagtagcgaatctaaatctttttttcgtacattattagagaaatacaacgagttatgtaaagatcttgacgttgaccaaggtgcttgtcgaggctgtgtacccgttgtaaaatttgatcccgaacaagatgataaatctggagaaaaaacaaaagatgtttaaattatcttaaatgggatagagaaaaatctatcccatttatccgttctaaacatgtcatactatgatgtcccccccccattcatttctaaaagaatgatttaactctcgcaattttattcataatctctataccatttgaaaatttttatttggagtctttatgtcatctactcaacaattccaaacgctgtttgaacagtcgttgaaaaactactgtgaagagcgttttttaaaaacctgaacaactttctacacaacaatggtatcaattcattgccgaagtcagccaacaggcgattttgcaaaatttttctaaaaacgcaccgcttgtaaacactcgcaaagtaaactatctctcaatggagttcttaatcggacgtttactgggtaacaacttaatgagtctgggcgtttatcaatatgtgcatttagcccttgctcaatatggtaaaaatttagtcgatattctcgaagaagaacgtgatccatcgttaggtaacggcggtttaggtcgtttggctgcctgttatttagattcaatggcaagccttgctcagccagcagtgggatacggattacactatcaatacggcttattcaaacagagctttggctgggcaggtgaacaacgtgaagaaggcgatgcgtggagccgtgatttctacgctcaacaatatcatcgcccagattttcgtcaaaccgttggctttggtggcgaagtatggcatcgtgacggtgataaatatgaatggaaaccagcgtggacaatttatggtaaagcctttgatttacctgtagtgggttataaaggggttcaacagccgttgcgtttatggcaaggttatagcgaaacgtccttcgatcttgatcaatttaacgacggcgactatcttgagtctgaaagcaaagtggttgatgcgtcaaaattgactaaagtgttatatccaaacgacaatcatcaagaaggtaaagagttgcgtttaatgcaacaatatttccactgtgcttgctctgttgccgatattctaaaaaatcaccttgcacaaggcagaaccttagagcagttgcctgaatttgaagtgatccagttaaacgatacacaccctgcgattgcaattcctgaattaatgcgtcttttgattgacgaatacggtttatgttgggatcgagcttgggcaatttgttcaaaaacatttgcttacaccaaccatactttattgcctgaagcgttggagcagtgggatcaaaatctcgtcgcgaaattgttgccacgccatttaatcatcattgaccgcattaaccacgagctttatcaacaagtgaaagcggaatttagcgaagcagaatttgcagatgcgtgggacgaaacagcggtcttaatgaaccaccgtgtgcgtatggcaaacctttgtgttgtaggatcttttgctgtcaatggtgtggcacaaattcactcggatttagtggtaagcgatttattcccagcttataaccgcttgtttaaaggtcgcttccataatgtaactaacggtattacccctcgtcgttggatccgccaagcaaacccattactaagtgcgttgttagataaatatatcaaaggtgactggacgaaagatcttgaattgttggctcaaattgagaaatttgccaaagatccacagttccaagcagattacaatcacatcaaacagcaaaacaaacagctattagcgaaagaaattgagcaatcacttggtttaaaagtgaattgcaatgcgattttcgatgttcaaattaaacgtttccacgaatacaaacgccaacatttgaacctgttgaatatcatcgccacttatcaagagcttaaagagaacccacaacaagaggttgtaccacgcctgtttatctttgcaggtaaagcggcaccaggttactttatggcgaaacaaattattcaagccatcaacgctgtggcaaaagtgattaacaacgatcctgatatgcaaggtaaattacaagtagcattcttaccagactaccgtgtaagccttgcggagaaaatcattcctgcggcagatgtttctgagcagatttctcttgcgggtaaagaagcgtcaggtacgggcaatatgaaattagctctcaatggtgcaattacgcttggcacattagacggtgcaaacgtagaaattgcagaatttgcaggggaagaaaatgtcgtgattttcggacataccgttgaatctgtgcgtgaattgcgtgcaaaaggttatgtgtctaaaacgtactatgagcaagatcctgtattaaaacgagcaattgatgcattagcggacggcacattctcaggtggtaataaagatacctttgaaccgttagtttatgatctgttaaacaaagattatttctgtgtgttagcagattttgcaagctaccgtgaagctcaaaaagaagtcgcaaaacgttatcaagatcaaaccgcttgggttgaatctgcgattcttaatacggctcgtttgggtatgtttagctcagaccgttcgattcgtgattatcagacacggatttggaagaaatagagatatggtagctaaaaatgatttttggtattcttagctactatgttctctattacactgtaaatactggtgcgagctagacactcgcaccaattaatttagatattattagaatttataggttaaattcgcagtgactttacgtccttcgccaaagaagcaagcgtaactacaaccactgatatattttttattcgcaacattcgttacgtttactcttgtctcccaattctctgaaaggctatatttcgccatcagatccactagtgttcttgctggaacgcgaatattggcattattgtagccatccatttctgttggagttgttccagtataacgaggcacaacccctaatgttaagccgttaagtacattatccttaaatgcataattaactaatgcagaataagtatggtttggttgtaatggagtatcaatacgaggtttatctaagcgatgggattgagcaaatatataactataagctaaagaagtagataacgattcagtaatatttaaatcagcttgaatttctacaccacgatttttttgcttttcaacctgagccattgtggtgacatccccactacgagccgcgacaagagcatttttctcttttaagtcaaaataagccacagaaatctgcccattgataaatgatggcaaatatttaaagccaacttcatattgcttaccttcataaggcttataaattgatgaaccgtttgtagcattatctaaactacctgaaagaggcctaaaagattcagaatagctaaaataaggtgctaaccctaaatctgtcatatacattaaacccgctgaataggtagtattattaactttattttctgattttgttcctcgaatatcgctgtgacctttaacaaaatcacgtcttacgccaccagttacagttaatttttcgtttaaacgtaattgattttgcaagtacaagcctagctggcgttgtttatctttataaactggaacatcagtcaaggtaactggagcggtaacaagttgagtaatatgatagcttgtagcaggccaagggaaatcatataccccatcaaccttgctgtgttgataatcaaaaccaccagttagggtatttgaaatattatctgatttccattctttgcttaaacgggtgtcaatagtatgggaatatgttttaccatcagcaaataggaagccttttttagccatagtattacttgcgccacctgttgtaggatcccattccatgccgtagtaataggttacaaattgctctttatctgttttggcaaagcggtagttttgtgagaaagttaagtcatcggtaaatttatgagtaaattcatatccaatagcatattgtttattacttacatatttaataatctcaatactttctaaaccatagacatttggttcccagccaaagtacgcatttttatatgatgaagttccatctactcatacacttgatcctaagccacgaatattaaaccagtcattagtatctaaatctgaaccgtacatttgggtattaacaccagcttcatagcgtaatgcttcatctaattgatggacggctctatccgttaactgctcttgcgaaatcacactaacagatcgaggtgccatataatcaactttcccagcctttgcaactgaccccaccacactcacttcatcgagtacagcggtattgttgtttgcagtctcatttgctattgcattgcttgcaatggcaagtagtactacttgagaaattgttgaataaacaaatgttttttttcattttaaagtcctttgtgttaataccaaattgtagggttgaacccgatgtccacacaatcagttggttcgctcttgggtcgccactggcaatggcgatgcgttgcaaagtgtcaaacagtgccgataagctgatccctgtgagtagtattttttcgggcaacattccgttgcgttggttaattgccattagcaccaacagtgctacaactgccccagtgatccctgccaaccaataccattctgtttgagctgtgttggtaagaaacagtaccgccaaaatccccatacttgtaccagacgacacgccaagcagttcagggcttgccatcgggtttagggttaaacattgcaataacacgccagccactgccaataaaatcccaacagcaacggcggtcaaaatgcgtgggtaacgtagctcgacaagcggtgcgtaaaattcgttaaattccaatacattccaaccgcttgtgcctttgcctaatacgagtgcaagccatagcacaagtacaaaaacaaacacaatcggcagtaaggtgtagcgatgaaaacggcgagataggcgagttgatgtttctgttaaacgccccgagtaattgccatttcagcgttctcacaccaagttggcgaataatggtggcggacgctagcccgataaaaccgagcataccgacacaacttaccaccgctgaaatcatataagcactgataaacaccccgaaaaaacgcagacgattaaccggcacaccaagactttgggcattgctgtcgtttaaggaaagtatggtaagcggacgaagcaatatggcaattaatccgccacaaatgaccgcttgtattgccaaaaattgcggatctcgccagctctcttgtgccaaagaaccagctccccattgtgccaagccccgtgcttcttcagggtaaaacaacatcatcaaggcggagaatgaaccgaaatagagattaaccaccaagccagccaaaatcagtaacagtggtgacattgtttttcgcattgccaaagttaaaacaaggatcaggctcaagcctgccccaactaatgcgatggcacttgagctaatgtctaaccaattcggcataaaaatagccgtgatagttagtggcttggggaagatgttgcggaagataagccacacgtttggcaaactcacggtttgaccaagcgtcaagcggttggttatcaaaaagaatttcacccgatgaaagcggttgctgtttggcaagcaatttgattaacgtggatttgcccgaaccgttatgcccgatcaatccatacacttttccttcgaaaagtctgttgccacgcccacttggatagcaaaaatgattactgtggcaattgcccgaaattgaaaaaactgccgaaagatgagttgatggaatgggtgagtaagctctgctaatcttcaaaatcaaattacttaattcaacttttacctttagtgtttacacattcactagatactatctatcattaacaaggcaagatcttaattgctaatccacctgttgaagtttcgcggtatttcgcgttcatatctttccctgtttcatacatcgtttcgatcactttatctagggtcacgcttggttgtgtcgttcggcgtaatgccattcggcttgcattgattgcttttaccgaagcaatcgcattgcgttcaatacaaggtacttggacttgtcctccaacaggatcgcaagttagccccaagttatgttccattgcaatttctgccgccatacatggcgtggtaaaaagtcgtaatggaacggcatatccgcaaaaaaatcaaaggtgattgttttagcatgttccggtcttgcttctgcaagacataaattttggtgctgtttgacatcacttacgaccgtatcaatacgctcaatatctacattgtctggcagatagcccattaatcccataataatcgcgatatccgcactgtgcccacgcccagtcaatgctaatgagccataaacatcgacttgcaagcggtcagtttctgccaattttttgcaatcaattaaatgatcaataaattctttacccgctttcatcggaccaacggtgtgggaatttgaaggcccaattcccactttaaacatatcaaagacactaatcataaacacactcaaacataagccactcaagacatattttagcgtaagttctctataagaggaatgttaccgatttatgtatatcattttggttataagttagagccttcagttattttaattttttcactaaaaacggtagattgagctggaattttcaacttagggaacttattatgcgatattcaaaactctttctcggcttgggttttctttctgcttcatgtgccgcgatttcggcaccgacaaatacattggtcaactgtattgcgacagcaccgatgaaacttagtccggcaattacaaatgatgctaatgacttcaatgccagctcacaacaagtctataaccgcttagtcgaattcaaagccggtaaaattgaagtagagccgggtctagccgaacgttgggaaatcagtgaagacggtttggtctatacattttatctacgccaaaatgtgaaattccacagcaacaaaacctttagcccaacccgcccgttaaatgccgatgatgtggtgttctcattccaacgccaagcggacaaaaatcatccttatcataatgtttcggcaggaacctacttctactttaactggatgaacttaccgagtatcttaaaatccgttgaaaaagtggatgactacaccgttaaaattacgctgaataaaccgaatacgccgtttattaccacggttgccatggactttttatctatttattcaaaagaatatgccgatcagcttcttgcccagggtaagcccgaaactcttgatcaacaaccgattggaacggggccttttattttccaaacttatcagaccgaccacgcggtacgttacactgctaacgtagattattggaaaggcaaagcagacattgaacgtttaatttttagcattacccctgatgccggaacacgttatgccaagttaaaagccggcgagtgtgatgtgattgattttccgaatatctcggacattgctcagatgaaaaaagatcctcaaatcaatctacttgagcgtgagggattaaacttagcttacattgggctaaataccaccaaacctgaactaaacaacgtaaaagttcgccgagcccttcaccatgctaccgataaaaaagcgattgttgatgcggtttatcaaggcggcggaacggttgcaaccaatccgttccctgatgcagtattaggttataacccgcatttgccacaatatgaatttaacttggaaaaagcaaaagcattattggcagaagccggctatccaaacggttttgaaacggaaatttgggtgcaacctgtggttcgtccatccaatccgaaccctcgccgcacggctgaaattattcaagcagactgggctaaaattggcgtgaaagcaaaactagtcacacatgaatgggcggattttaataaacgcacccgtgaaggcgaatttgccgcaggtacttatggttggacaagtcgtaacggtgatcctgataattttctattccctttatttagccaagcaaatatccccggcaccaattactctcgctggacagatgaaaaatttgaggcgctactcgcctcagcggtacaaattcaagacacacaaacacgtgcaaaactatatcaacaggcagtcgaaattttccaacaaaacagcccgatcattccgtttgcccactccattaactacgtaccgttaaataaacgggtacaaggctttgttcaaaatccgtttggctataccgcattttatggcgtaagtctgaagccttaatctattagggagcttaaaatattaagctcccttatataagtctttctaaaaataaatcgtttacatcatttacttactattttgatccacagttgatagaatcctttcatatctacactaaaaataaggaaatattatgtctaaactctttcccaatgcacaacctcgtacccaagccccttatcgttttgatattgtgggaagttttctacgtcctgaaagcttaaaacatgctcgccaacaatgccaatgtggcaatttatcttgtagtgaactgactcaaattgaagatgctgaaattacaaaattagttgagcaacaaaaataataatagccagctattagatgatattgctgatgcttataaataggcaatagaaaaattctatgcattaggttgccgtaatttacaattagatgatacaagttggggagagctttgttcagaagagaagcgagctgcttatcaagctcgagggttcgatttagaacaactcgcaaaagactatgtttatttagtcaatcgcgccaatacatagacattaaccaactctgtcttagtccacaatgtggctttgcatcaactgaagaaggtaacattctaacagaagagcaacagtggaataaattaaaatttatccgagacatcgctgaagaggtatggggtaaataatacatttaatttataaagcggtcggatttgcaaaattttcgtcaaatcccaccgcttgttaatcaattaagccctacgccacgttgtaccatttgcaccatcttcaagcacaatgcccattgcggtgagtttattgcgtgcctcatcggctaccgcccagtttttgctggctctcgcttcgttacgttgtttaatgaaggcttcgatttctgccacttcatcattattggcatcgccttgtaagaaggtttctggatcttgctctaacaaacctagcacgcctgcaagttgtttcagacgagctgcaagtttgttcgcttccgcctgattttctgctttgagtttattgacttcacgagctaattcaaataacaccgcgagtgctccaggggtattaaaatcatcgtccatagactctttgaaagcggtcacatactgatcgttttctgcaagttcaacattccagtcacagccacgcagtgccgtatataaacgttctaacgctttgcgagccaagccgatattttcttcgctgtaatccaacaagctacggtattgtgcggttaagaagaagtaacgaacactttcacaatcatatttgtttaaaatatcacgaatggtgaagaagttattgagcgattttgacatcttctcttcgttgatcgtaagcattccagtgtgtagccaataattcacataatcgtcaccgtgagcacagcaagattgtgcgatctcattttcgtggtgagggaacattaaatccgaaccaccgccgtgaatatcaaaatggttgcctagctctttgctgttcattgctgaacattcaatatgccaacctggacgacctttgccccaaggggagtcccagcttggttcgttctctttcgacattttccataatacgaaatccatcgggttgcgtttgaccgatttaatttcaacccttgcccctgcttgaagctgttcaagattttggcgagataaggcaccgtatttttggaaagattcgacattgaacatcacgtcaccatcttccgctacataagcgtgacctttcgctaagagtttttcgacaatcgcaataatttcagggatatgttgcgttgcacgaggttcaacatcagggcgaaggatatttaacgcatcaaaatctttgtgcatttcgatgatcatacgatcaacaagctgatcgcaagtttcattattttctaacgaacgtttgatgattttgtcgtccacatcggtaatgttacgcacatagcgtaagttatagccgagatagcgaaggtaacgtgcgatcacgtcaaaagaaacaaaagtccgtccgtgcccaaagtgacagagatcgtaaaccgtgacaccacagacatacattccaacgtgatcagggtagataggtttaaattcttctttttcacgttttaaggtgttataaattttgagcattatttcctctattatttaataaaaaattgtcaatccatctaagaaaataagaggaaatattataaaaaattatatttatattcttcatttaataccaaatttctcttttaaatcgctttcaaatttctgtagttctttattcagtaacaataatctatccgacttttctttaattttttcctgtccttctaaagtcgggttttgcatagtttctactgattcaataataaaatcatttaataaaatcagattttctttaatccttaatttcaataactgaatatccgtatttttaacctctatcatctctagattttgtataatagaagatattctagttttaaagatattcaatccatcttcaatttcagatttatcttgactgctcagcttttgttgcaattctgctaatacctgttcttgcttaatattccataataccaacttattaaagtcttccacagcttcaatagaagccgaactctccactgtatgcacatcttcttttgatgtttttttctaaagaagtactattgttactctcatgctttccgacattatcacaagaagataaaaacatcatacataatactaaggtaataattttaataaacttatttatttcaaaatatccaaataatactaaaaaaatctttattaaatatattcatataaatcattcttatccagttattacacacttattgcctgctgaataagtagcttttttacaaaactattttgattagttgcagataatccaacacctctaactaattttttaaatggattattgccagagaaaaggtgctttaagccctccattgcaactaaaacctttatagcttctaactttctaactcgttcaaattgacgtaaattacggtactctcctatatcttttccaaaggagagtaatttctgtagctcttttgccaatagaatagcatctgcaaaacctaaattaacacctaaacccgctagaggatggatcgtatgagctgcatcaccaatcaaagcaatcctttgctgggcaaaatcgcgagcataacgtgcggtcaaaggataaacatccctttcactttgtaactcacatattcctaattgattatcaaaagcaatattcaattgtttgagaaaagatttttcatcactattaactagtctactagcctcaagtgtaggcaaagaccaaacaatagaacaaagatgttcatcttttaaaggtaagaaagctaaaatactatcaggtgaaaaaacttgacgagccacttgttgatgcatttctgttgttctcacattacatactaatgcagtgtgttgataatctctactaatcaatggaattttagcttgttgacgaacccaagaatgagctccatctgcacctataactaacttacttgtaatcatctctccgttttctagagttaaaaaagcgcagttatcattaatgcctaaaaatttaggagcatccaatatcacttctacattatgctgatgaatgacttgcttccatagagcataacgaatctgctgattatcaataataaatcctagctgctctagtccaagttctttgattacgggatctttattgtcaaaacagagacttgaaaaactatccttttcccagacatacatttggtcataaggagataaatcactttcagaaatatgataccaagcacctatttcctcaagcattctttggctagtaaaattaattgcacttactctattactgattgacttacttaaatagggaactgttttatcaataatcttgatttgacaattactatttgcaagtaatcctgctaaagctaagccaaccattcctccaccaatgatggtaatatctgctgttttcattctacgatgtcttataatgtttttctaaactacagtgacgaactcttacttttttgcctttactttcaatatatctggctaatttctctgcaacaaatacagaacggtgctttccgcctgtacagcctatggcaatcgttaaataactcctattattttgctccaataaaggcaaccacacttctaaataattacaagtatgagaaataaattgatggacttctgactgattttctagaaaatctataacaggtttttctaatcctgtcataggacggagctcaagattccaatggggattaggtaaaaaacggacatcgaaaacataatctgcatcggcaggaatgccatacttaaaaccaaaagattcaacaataatattcaattctttctccgatgatccatttaataattctcttaatttctctgctaactcatgtgaagaaaagtacgttgtatcaataatataatccgcatgctgaaataatggttcaagaagatgattttctaaatcaatcacattttctaaagataaatcatgggtagataatggatgtaaacgacgagagtcactatatcgacggactaaagccttacgctgacaatcaagaaagattaaagtttttgaaatgtgagagggaaacgcatgtaatacttgctcaagcacatctggatcttctggtaaatttctcacatcaaggctaacaacaacagatctcttcaatttttctaaataatctgttaactggggaattaaagcaagaggaatattatccacgcaataataccctaaatcttccaacgctcttaacgcaacagactttcctgaaccagatcgcccgctcataataatcaattccacattacattcctcgattctaaatttttgtttaccgaataatcataataactcaatacttgccaaatttcttctctggataatgcagctcttagatgctttaacaaattcttatcacttaattgctgtgctatttctctcaaagaatccttatattctacacaaattttttctgaaaagaatatggcataaataatatccacatccttatgatctattgattcaaaatttattcctgcctctagtttcaggaaaatagcaattggtttctctagctgaaattcttgactcatcaacaattttgcgtgaggtaaagccactccattattaattccggtagaacctaatttttcacgtttaaagaaatagctaaaacattctgctggatgaatacatagtttatctgtaggtgaaaggctattatttaatatttctgccatcgccttccccagaaactctaaagcctgttttttattagaaatgggaacattgtaataaatattattaatgtctaaaaatgtggttaattgcatcataaaaaatcaaacgacaaaaaaatatcttaagaattttatattacagcctaaattgctcacctaaataaacttttttcacatcctcattatgtaaaatttcttgaggaatcccactagctatcatctgaccattactcacaatataagcacgctcacaaacatctaaggtttctcttacattatgatctgtgattaaaacacctaatcctcgttcctttaaattcacaataatcttcttaatatcgatcactgaaataggatcaaccccagcaaaaggttcatccaacaaaataaacttaggattagctgccaacgcacgtgcaatttctactcgacggcgttcaccgccagataaagattgccctaagctgtgacgaatatgctcaatatgaaattctgcgattaattcatctgctcttgcttgacgctctgcatcggttagatctttcctaatttgtaacaccgccatcaagttatcataaacacttaagcgacgaaaaatagaggcttcttgaggcaagtaaccaataccttgttttgctctatcatgcataggtaaaacactgatatcttgatcatcaatacggattttaccatgatcgtgacgcacaaggcccactaccatataaaaagtagtcgtttttcctgcaccattaggacctaatagtccaactatttcgcctgatttaatatttaaacttacatctttaacaacttggcgacttttataacttttagccaaatattcagcatataatgttggcatacagaattcctatttcttatcactttgcaattggtttggaattaatacagtttttactctttgtcggtcattactcgtcgctttaaggttctgttttttgacatcataagtaattttttctgctttaatggcactatctagctgctttaattcggcattgcctcttaatatcaaaaattcagaatctaaatcataatgtacagaattagccgtaccattaacaatcttaccattatcaagggtctgctgaaaaacaaccggtgtgccaaaagcctcaataagttccttttgagtatcccttctaatgattgtaactttttctgcattaagcttaattgacccttgagtaataacaacattgtcgctaaatgtcacaatatttctttctatatccaatgactggctacctgaatcaattttgatgggcatatttctatctgtttccaaagccttaaccgatagatttacaagacacaatgcaattattaatacaagtttagttctaaaattcattctatatccctatgtaaaactctaattatttatcaacattaataaattttggttcaatataagttttcacatctttggttaaggttgccgtttgttttttcaaattgccttttaagccaattccagtacttgtaaatccaatgcctgttgatttcaccatactgtctgaaaaaatatcttgagtatttaaatctatgcttaatacttctgcttcgattttctgtaaccgagaagtcggatctaagctattaattttaatatttccacgcaaattcaatattttgtctttggtaacatctgcataatcggcttcgacttgccactgttttaatgcactttctgcatcaaataaattaagtaatggctttagaaattctattcgttgcgtactttcgtaacgtttaacctcttctgcttgagcagaatattgcggctttccatttaaatcataagcacttgtagaaatcttttgccctatatactctgcacttccttccttttttattagctgagataatccagtatcatcgctttgttgactataataccaaccagcaagtactgctgctaatgtggctagaataatatttaaacggatattcatacaatctcttcttcgtttagatacagctgagaattttaacataaatttctacggcaatatagaacgaaaattgcaagaaaagttcatacaaaaaacctcaaggtaagccttgaggtttttaagcgatgtctatggaattacttcgcagcttttaactcttgataatatttttcatagagctcaatcgcatcacccacatcatcttgccactggcttttttgtagcacttcagcggttggataaattgctggatcttcggtaatctcttttggtaatttttctaacgcttttacgtttgaagttggataaccgatttctaatgtcaatttctcagccacaggtgcactcaataagtagttaattaacttgtgagctgcatctgggtttttcgcattagatggaattgcaagcgtatccacccataatactgggccctctttcgggaacaccatatttacaggagcttgctcttttttcgcaatacgtacagaaccgttccataattgacccacttctacttcaccagaaataaatgagttagcagggttatcagagctaaatgctaatacgtttggacgtaattttaataactcttcataagccgctttaatcactgctggatctttagtatttggatcttgacctaattttaataaagcaatgttgaatacttcacgagcatcatcaagtaattgaaccttacctttaaactcaggtttccataaatcgccccaagcagtgaaattatcacctttgtatgaattagtattaaatgcaatacctggtgcacctaataattgtggtaaagagtatttattgcctttatcgtaaggtttatttaaccagtctgggttaagatctttgatcacaggtaatttgctatgatcaagctccattaacataccttcacgtcccatttttgacacgaagtagttacttggtgcgattacatcataaccaccatctttaccctgaattttgagtttcgcatacattgtctcatttgattcaagacttgaaaccacaaccttaatacctgtctgtttagtaaattcttctaacaaaccttctggcacatattctgtccaagtataaagatgtacagtgtcatttgctaatgcactatttgcccctaacatcaccatacccgaagtgaatgcaacagcccattttttcatcaatgtattctcctaaaagagtaaaataaagaagaggttggattactccaaaaaaaccaagtctttcaaataaaagacgggggcattctaagcccccccctgtattttgcaacaactttatttcaaaatagcttattttttaagctatcaagcctaatattacattactactacgtcaaattgatcttggtgataatacggctcaattttaatttcgacttttttaccgataaagacttctaattccgcaagcaatgcgtgagattcttcattaatcaagtattccgccacgctacgagaagcatatactacataacgttccgacttgtataaatgatgaactcgaacgacctctcgaacaatctcataacagactgtttcaacggtttttatcgtacctcgccctttacaagaagaacaatcgcaacataacactcgttcaaggctttctctggtacgcttacgcgtcatttcaaccaacccaagttgggtaaaaccattgacatttgttttgactcgatcaccttttaaagcaagttctaaggactctagcacacgctggcgatgctcttcttcctgcatatcaataaaatcaataatgataataccacccaaatttcgcagttgtaattgatgtgcgattgcctgtgttgcttcaatgttagtattaaaaatcgtatgtgcaagatttcggtgtccgacaaaagccccagtgttaatatctatggtggtcattgcttctgtctgctcaatgattaaatacccacctgattttagatcaacacgtttatccaaggctttttgaataccatcttcaatgcgataaacatcaaagaggggtaaagtcccactatataaactcacattcttggctaactctggcataaactcagctaagaactcttttacctgctcataggtcatttttgagtcaatttgaattgaatgaatatgcgttccaacgaaatcacgcaacactcgttgtgccaaagctaattccccataaagtaaagatctcgcaggatattttccttttcgctctagtacttttcgccataaccgctttaagaaagccgcatcttgttcaaggctctcttcgctcacactgtcagcagccgttcttacaataaaaccgcctagctcatcacaatacggctcaactaacgattttaagcgattacgttcttcttcactttcaatgcgttgcgacacgccaacgtgactattttctggcataaaaaccaaataacgagagggcaatgtaatgtctgtcgtcaatcttgcccctttagtacctaaaggatctttgaccacttgcaccacaatatcctgcccttctcgcactaactcgctgatatttttgacaacaaattgctttttctcgctttcatcaacacattcagtatgagaaacaatatctgaggcgtgtaaaaatgccgctttttctaagccaatatcaacaaatgccgactgcataccaggcaaaacccgtgtcactcgtcctttatagatattaccgacaacacctcgctttgcctcacgctcaatatggacttcttttaacacaccattttcaaccaatgctaccctcgtttcacttggggttacattgactaataattctgcacaattcatcttaaatttatccctagaatcatttacaaagatactagtactgattttcttaaaatatacataaatagttatttaccataatagaataaaggtcctaatggcatctgaggaatactaaatttctcaggataaataacttcaaccaagtatagtccctcagctttcgctgttggtgcagccaacgtcctatctcgtttttctaatagccatttaatccattcaacaggtttatcgcctcttccaacctcaatcaaactaccaactatatttcttaccatgtggtgaacgaatgcattcgcttgaatatccaatataatatagtcttgatggcgactcacaatgagatgatgaacatttctccatggcgtatgtgattgacacttcgcagctcgaaatgaactgaaatcattctctcccaataaaaactgccctgcttcatgcattttttcatgatccagagaatagtgataatgagaaatccctttcggtaatatggctgaacgtaatttattattataaataacataacgatagcgacgagcaagagcactaaaacgagcatgaaaatcgtcacttactccaatagcccatttcaccacaatatcttctggtaaatgagcattggtccctaaacaccaactctgcataggtcgatttacatccgtatcaaagtgtacaacctgcccagtagcatgtactcccgcatcagttcgccctgcacaaaacacttcacaagatgaatttgcaatgactgataaggcttcttccaatctttgctgtactgaatcaacatattgttggcgctgccacccacaataacggcaaccatcgtactcaattccaagggcaattttcattagacaacctaaaacatttaattaatctgattaactcttttttttcataagaaagtaacttgataagttactatagctaaatcgtattatttataccgctgtccgtatcatttaatgattgacatccaaacaaaaacagccagtaaatcattttattcagggattaattcgctcttcgggcattatgccagattagtatttaatttaaaacaactacacaattttgcccccgaagagaatacaacatcagtaaactcatgcagatattgtaaaattaattattgtggaaaaactcaaattcttccctacttttactgaacatttgttcttttagaacgccgagcagctcttgtctgacaacagaaagttttggtcgttcattttgttggaacaccactggacgacaaaattccattgccttaatgcctaagcgagcggtgagcagtcccataccaatcccttgtgccgctcgaaccgataaacgagcggtgagattttgtgagaaaaaatctaacccgacatcgcaggcaatttccgttgcccctgcaaagaccatattggtcatcaccattcggaacagttttaaacggctgatatagcccaattccataccgtaggctttggtgattttattgactaaagcaatgtttcgccacgccaccattaaaatatccaccaacgccaaagggcttacggcaacgataattgcattttccgccgcatttttactgattagctttttcacttggttatcaatcgggcttaatacattttcactgaaaagatacagcacttcttggctgttataggcttcgtcaagctgagattgccaacgctgttccgcctgttgaaccatcggcgtttgagccaaatttttaaccaccaatttgcaaaattctcgtgctttttcaccgcttgtatccgctgtttccagtagtaattgttggctcacttgctgatgataatgatgtttacgcaaccaacgtaactttctccattcgttgataatagcccctacaccagccaaactgatgccaaaaaaggcaacggcaaaggcaaagtagatccactgatttgcttgccaagtatcaattaaccattgcactgattgagcaatggtcgcaacgccaaacagagccaacgcagctagaaataaccttagccagaagcaagagggttttaaactttcttcaataatcagttctgcttcaactgcttttggatcttcgtcaagctgaatgtctgcgtcgctaaactcttgttttggttgatgttttacttctgtttcaaccatttcttcggtaaaaatgcgtttttccattaagatctcaccgcttgtgtaatgtgttgctttaacccttcgtagccgtgttctgttttgagaatatcaaacagttgcaccgcttcgggatactctttatcgagataacgtagccactgtttaatgcgtgcgacgtgataaaagccggtatccagttcgttttccatatgtacatattgaaataagagctgtaatacctcgttccacgccattttaggctgattatatttcacaactttgcttaaatttggcacatttaacgccccacgcccaatcattaacgcatcgcaagcggtcacttcacgacatttttttgcagagagataatcccaaatttcgccatttgcaattacagggataggcagtcgtttttttatctcgccgatggcttgccaattaatgcgttctgctcgatagccgtccattttggttctgccgtgtacggtaatttccgttgcaccgccttgcaccaccgcatcggcgatctcaaaggcttgttcgctactgtcccagcctagccgtactttgaccgacacaggaagatggctaggcaccgcttctcgcattgcttttgttgctcgataaatcaattcaggttgtttcagcaaggatgcaccgccgttactgccattcactgttttagacgggcaaccgcagttgagatcaaccccgtacgagcctagttcaacggcaagtgctgcgttttctgctaaccattgtgggtgttgtcctaaaagttgtacacgcacaggcgtacccgatgaggtaaaaccgttattatgtaattcagggcaaaggcgataaaacgttttcttcggcagtttttgatcgaccactctcacaaattctgaaatgcacagatcataatcattgactgtcgttaataattgacgcacaaaaggatctaacaccccttgcataggtgcaaggataacttttggtaaattttccacaaaatccgaccgcttgttagtaagaagaatggcgtaaacgtagatcagggcgagcaattaagtagatgattaatgcagtaattgcccctagcgtatcggcgagcatatctttttgtgcgtcccaaatatcgccttgcgaacctaaaaattcaatgccagcattacccccttcaatcactgcatattgccattcgataatttcataggcagcggcaaccgacataataaaaaagagcgaaaagaagaatgctatgcccaagccgcatttacgtttacgcaataaccattccgccattgggtaactataaaagccgataatatagtgagccacacggtcaaagtggttacggtcttcgcctaaaaaggtcaaatattgatttgcccagtcaaacggcacatttgcaaaggtatattttgcaccgattaggtgcataatcatccacagagacatcagcacataggcaagcccactaaattgaaaacgttgataagtgagtagaagtagagcaaataccacaaaaatcggcattacttctgcataccagacggctctgtctgtcgggttaaaaccagaccatacggaaacaaccgtaatcacaatcgctaagaaaagcggaacgatatgagaacttttttgcattatttccaactttttgatttacaaataagatcataagcagcttgaatttgctgtgctttttcttttgccacttccatcatttcaggcggtaaacctttagcgactaacttatctgggtgatgttcattcattaatttgcgataggcacgtttaaccgtcgtttgatcgtcgctttctgatacccctaatatactataagcgtcttttaaacttggcccgctcgaacgctgataaccgccataatttccttgatattgtccttgttggcttgagccgtgctgttcatattgataatagcctgaacggaaacgttgagctgctgccaccattgcgatcatctgttcaaactgcaaacgggacattcccaatgtttcagcaatagtgaataaaatttgctgctcattgccatctaaattgccatcttgtaacgccgcttgcatttggacttctacgaagaaacgcaataaatcacggcgttgtccacaggcttcacgaaactcttgcataacttggcgtaacgggaaattagcctcttttcctaaagtaaaggctttttgagcaagttgttgattatttgcatcgagtttcatattcgccattaactgacgggcaagctggatatcattttccgttactcgtccttttgctttggaaatatgtcctaataccgcaaaagttgtctgcataaagagtgactgacgagttagtgctttgccaaacatagttgaagatacgctacctagctcatacagttttttatcgccccaatgcccaataataagccctagcaaaccgccaaaaaatccgccaaaaaacttataacctaaaatgaaaccgagaattttcccaataaattgcatcgactgcccttacttacttattcaaaattgtgagcattttaacggaaaatccttaaaaaataattaagtaatatagaatttacacataaaaataaagccccgaattttcggagctttactgtttggcattttagaaaactaaaaattagtactctaacactgcacgacggtttttagagtaatcagcttctgagtgacctaatactgctggtttttcttcaccgtaagaaactgttgccacgttgctagcacctttagttgctaaaaaatctttaactgcgtcagcacgacgttgacctaaggcgatgttgtactctggagtaccacgctcatcagcgtgacctgcaacagttactttgcctttagatgcaactaagtattgtgcgtgtgcatctaaaagttgttgatcttcagcttttagtgtgtagctgtcgaaatcaaaatatacagtgttgtaacgggtttgtaaatcttgaacagacataccaccgaatgtttgacctgcattagcacttgcattagcacttgcattgtcgtttgagctgctacatgctgctaaaacgaaagctggtgccgcaatcattaaaactttagctagttttttcatttttttctccaaaaagaattattgtttagtcagataaggtgaccaagcagggaatttatattgtccacctgctcccggcaaattagctttgaaacgcccatctgcggacaccaattgtagcactttactcacacctttggtagagctataaataaccattgttccatttggtgaaatacttggactttcgtctaaaaacgtagaactgattgcttctgtgctacctgaaacaagatctcgtcttacaattctatcacctgaaaccatgattaaattcttgccatctgccgaaattttaccactgccgctgccaccaattaagctagcaccgccaccagatgaactcatttgataaacctgtggtaagccaccacggtctgatgtaaacaggatataaccaccatctggtgaccagcttggttcggtgttatttcctgcgttactggttaattgtcttggtgaaccaccgcccacccctgttacataaatatttaatacaccatcttggttagaagcaaacgccactcttgaaccgtctggtgagaatgaaggcgccccattatgccctctaagagatccgatcacttttcttgctcccgaacgaatatcgtgaacaacaacctgtgattttttgttttcaaaagtcacataagctaattttgaaccatctggtgaccattctggtgacatcaaaggctctttactttttacgatggtaaaggcattaaaaccatcataatctgatacacgcaactcgtaagaggacactccacgttgtaccacataagcgattttagttctaaatgcaccacggatctgtgttaatttttcaaatacttgatcgcttaccgtatgagcccctaaacgcatttgggcagccggaacattaaatgaaccttgtacaatcacattgcctgctgcccctgactttcctagggtatccactaattgataagcgatgttatagccaccacctactgcagacacttgccccacaatcacgttatcaatgccgatatttgtccactgttcaggattgacttctgctgctgaacttggttgagccggtaaactagcacgatcaagcggtgtaaacttaccactatttctcaaatcatctgcgataatttgagcgacatcatcaggtacgccccctattgctttaaatggaataaccgctatcggttgagccatactcacaccttggtcaatcgaaattctgacatctgactcagcttttacaccgacagaaaaaaataatccgacaataccaagaatactcgttaaacgagatactaatttcatcttaaccctctaggttgaactattgaacttttaaactaaaatctaatgttggtgatctatattgctgataaactgcatctgatggtgctggtggcactttacgggttgctacaattgcacttacagccgcatcacacactgctttatcccctgaaacgacttgatagttggtaatagtaccatctcgctctaggaaaattttcacatcacattgtttacctgcaaaactcggatcaacacggtattttgactgaataagttttttaattcgctgcccataggcattgccatcaacattagcaccctgacctaaaccttttgtaccgccagagccttgtgagccagcactatttttattaccgccgttgctcgtgcctccgccaacttcgccgccacttaaaaaatcatcaagcgctttattatttttcgctttttcagcttttgcagccgcttcagctttcgcttttgcctctgcagcagctttagctttcgcttctttttcctcttttgccttagcttctttctccgcttttagttttgcttctttttcagctttgagcttctcttctttctctgctctttctttagcctctttttcggctttgagcttcgcttctttctctgctttttctttagcctctttttcggctttgagcttcgcttcttgttctgctttctcttttgcttctttttctgcttgtgctttagcttgctgttctgcttttagctttttctgctcttcaagtcgtttttgttgctctgcttcttttattttccgttcttcttccgcttgctttgcaagggcttctaaacgttttgcttcggcttcagctttcaaacgagcagcttctgcaagtttacgttgtgttgcttcttcctgctgttttttcaactgttcttgtttaatttgctcttgtttcaatgcttcttgacgagccaattcttgctgacgtttttcttcttgttgcttctgctgagctaactgaattgccttctcacgttcttgttgttcagcaatttcttctggggtaggtttatcttcaacctcttccttaacttcctctttaggctcttctttaggttcaaccttcgcttgcccttgcttttcagcttttaatcgcccatattcagcggctacctgtccagtatcaaccatcacagcttcaagagattcactatcaccgccacttccgccagcagaagctaagtgagtattagtgaaaaaagaacccagtattaataagcctatcaacaataaatgcagtaaaactgacacaattatagcgagttctaatctatcattttgatatttcacgctctatcctcgctgactatttaccttcggtcattaaacctacggttttgatccctgcatcttttaataatgagatccctttcattacctcttcgtaaggtacgtctttaccacctgccacaaggaataaggtattattgtctttttggaaagcctcaccagcataagcaatgacttcttgctccgctaagttctcttgttcattaacttgaatgtagtttccgtcaattttcaatttgtacaaagcgaccccagcgatctctaaaataacaggggttttatcttcatttgaaacggattgactatggcgatcttcaggcaattccacttccacactttgactaataatcggtgctgttgccataaaaatcagcaataacaccagtaacacgtccaaaaatggcacgatgttaatttcagatttaatgtcattacgtttacgacgacggtaagacatagtttcctctttatctatccattcaaactaccacaacaagcggtagcatttcacttaatttttacttattttttcgcaaacgctttgcgatgtagaattgtggtgaactcatcaataaagttcacataattctgctctaatttgcctacacgcaagttcaaacggttatatgccattactgcaggaattgctgcaaataaaccaatcgctgtggcaattaatgcttcggcaatacctggtgcaacagattgtaaggttgcttgttttaccgcacttagtcccataaatgagtgcataatcccccaaactgttccaaataaaccaatatatgggctgatcgaaccaacagtacctaagaacggaatgtaattttcaagttcttctaattcacggtttaatgcaagattcattgcacggctagaaccttgaataattgactctgacgaatctgggtttgcttgctgtaagcggttaaattctttaaaaccaacgtagaaaatttgttcagctccagttaaaccatctcgacgatgttctaacccttcgtgtaaacgatgtaaatcttcgccagaccaaaaacgatcttcaaagtttaaagaatcttttttagctcttgttaatacgcggctacgttgaataatcactgcccaagataacacggaaaaagagatcagtattaagataactaacttaacaacaatactcgcttccataaataatgaaactaaattaaattcagttgccattgataaaaactccaaataaaacaattacattgagattatagcgttaaaagcctgcttaatatcttcaggtatggcgatcgctttcatttttgctagatcaacactcacgacaaccacactcacttcacacaagcactcctcatctcgccataatgtctgtttaaagactatttttgcaccctttagttcagaaataatgcttttaactgtgagaaaatcatctaaataagcaggttttttatagtcaatatccatttttttcacaacaaaagccattgattgacttaataatagctgttgagaaaagcctaattgacgtaaaaattctgttcttgcacgctcaaaaaaatgtaaataacgcgcgtgataaaccacaccacctgcatcagtatcttcataatacacacgaataggaaaatccattgcaatgccctatctatctttccaaaacgaaaaacgcccaaaaatcaggcgtaaattactcgccattttagagagagaaaaatcgttgtgcaagtatttttagaaataaattaaatataaaacaagcaatatgataagaacccattgctttgggttcttaatttaaaggctaatgcagcacgactaatgcaattaatgaaggtaagataatggcatatcccaacaacggcataaaaaccatttgccatcgtgttgatttaatctcaaagccaaaaccgtgaacaaataaaatcaacataccatagaaaacgcctgctactaaataaggaatttttccaccaaagtagagagcaaaggtgttggaatagagcaatatcattgcaaacattgcaatagaaaggataaaagaaagggcttgtagccagccctttcttgtgagttgatagagtgaattaaccatcttactcgtcaaacttacctgttttttcaatacttacagtgattactgttgcaaacagaatagcaagtaacacacctagtacccaagttacataaaacatattggttctccttagtataaacttgcacttttctcttcaatatatttagcgtcaagacgaccaaacattttgaagtaagtccacacagtataagctaatacgattggaacgaagatacacgccacaataaacattactgttaatgtgttatggcttgcagttgcatcccacattgttaaactcatttctgggtgagtaattgacggcattacgaatgggaacattgcaacacctgccgttaagatcacgcccgcttgcataattgatgaacataagaatgcaagtccaccattatttgctttagagctaaccacagtacctaatgcaccaatcaccgctaaaccaggaatgatgaataatactggcatttcaaagtagtttttgaaccacgcaccgctttctaatacgactgttttgttcactaaactagattgaccattgtgatccaaagcactggtaatcacaaagccatctttgaagtaaacccaaacacctgcaagtaagaatgcacctaacgctactaaagcggtcacttgagcaacatttcttacacggttacgcaattcgcccgttgttttcatttgtaaccaagttgcaccttgagtggtgagcatcattaaacttaccacaccgcaaagtaatgcaaatggatttaataagcctaataatttccaaagggttgaaccttcgtaagttacttggtttaactcgttaaagtggaatggtacgccttgtaataagttaccgaatgcaacaccaaagattaatgatggaacgaaacctcccacaaataatccccagtcccaagtattacgccatttttgatcatcaattttcgcacggtattcaaagcccactggacggaagaataatgccgctagaactaagatcatcgccaaatagaaacctgagaatgatgctgcataaaccgttggccaggctgcaaagatcgcaccacctgcagttaataaccaaacttggttaccgtcccagtggggagcgattgagttaatcattacacggcgttcaacattgcttttacctaccattggtaatagggttaatactcccatatcgaaaccatcggtaattgcaaagccgattaaaagtacaccaattaaaatccaccaaataaagcgtagaacttcataatctaacatattttactcctacttatttcgcagattgttcaaagtggtaacgacctgtttttaatgcacttgggccaagacgaccatatttgaacattaaatacatttcaactaccaagaatacggtatataaaccacatagcaagccgattgagatccaaagatctgccgctgttaatgcagagttcgcaacccctgttggcaatacttcgtacactgcccaaggctgacgaccatactcagctaagaaccaaccgctttcaatcgcaatccaaggaagtggaataccccataacaatgcttttaataacaatggtttagtacctactgtaccgcgtacattttgaacaaatgctgcgataatgagtaataacattaaaccaccggcaatcatcataatacggaatgaccagaatgttggacctacgtttggaatagtatccgctgctgcttttaagatttgctcttctgttgcatcaataactttatctgtatatggttttaaaagtaaaccaaagccaagatctttttgaaccgctttaaatgcttctttatctgcttcagtatagttaccagaacgtaatttttctaataaaccataagcaacaataccattgcgtacacgttgtacattctcttcacgaagatctttcaaacctttaatttctttgtctaaagaacgcgttgcgataatacctgcagcataaggaattgaaattgccatttcatttttcatttcagcggtgttaggaataacaaacgcattccacgcagctggagctgggtgagtttcaaattcaccttccattgctgccaatttcacaggctgtgctttaccgatttcatagcctgactcatcacccatgattaatacagaaatgatggcgactaaaccgaaacttgcacctactgagaatgaacgacgagcaaatccaagatcacgaccttttaagatatagtatgcactaatacctaatacgaagatcgcaccacaggtatagcccgctgaaacagtgtgtaagaatttagattgtgttactgggtttagcactaagtcagagaaactgaccatttccatacgcattgtttcaaagttaaattctgaacctgcagggctttgcatccaaccgttagcaactaagatccacaaagcagagaagttagaaccaaatgcgaccgcaaaagtcgttagtaagtgtttaccttttgataaacgatcccaaccaaagaagaaaagaccaataaaggtagattctaagaagaacgccattaagccttcaatcgctaatggagcaccaaaaatatcacccacataatgagaataatatgaccagttagtaccgaattggaattccattgtaatccctgtcgttactcctagagcaaagttaataccaaataacttaccccagaactttgtcatatccttatacacttctttacctgttgttacatataaggtttccatcaccacaagaacgaaagaaaggcctaatgtaagcggtacaaataagaagtgatagagagcagttaaagcaaactgcaaacgtgagagttcaacaacgtctaacatctcaaacctctttatatatacaagtctgaattattgattacaagaataccaagtaatcccccaatcaacattgtttttgcacagttaccaatcaaagattaataagtagcaataatgtcaagaatctattctactcgtaaataagcaaataaaaaatagcaaaattattacattgatcacatttttgagctaaatatttaaaaaatatgaaatttatattgttacaacttgatataaatcaagttaggcaaaataccactcatttatctgcttagcagctttgtaaattatttgtgaatagaatttctagatttaacaaattatttacaccgtagataaagatccttaaatagtacgtgacgataccttgagatctatgttaatatgcgtaactttcatctaacagttaaactaatcattaggaacactatgaaaaacgctattttacgttcaatgattatcgcaactggtgcgttattcattgcgataagtggtttcactactgaattgaaaacatcttcactggtaatgaccaaacctcaaaccaatggcatattacctgaacagtgccaaaaaatgtttcaagaagttgataaactgattgctgatgcagaaaaacaacctggtacacatactcaaatgcagacaatgaagaacaaactctcttcatcaaaacaacagatcctcaaattagatctcatcatgcagaaaaaaagttgtaataaagggctggttgcgcttaatggactgaaacacaatagcaatggagagtaaagaacacgatctatgtgatctcataccctgcgatattactcccgacagtctaaatatttataatgatttcttaattgctattttgtctattacaccagctcctatattgataattctattcatcataataagtttccatatgaaataagtattctaaattcataaaaaaactgatctcatatctaaatataacgatttttaatagactaaaataatgaataatttttgttgattagaaagttaaagccttataacaataaggctttaacctaattcttatataaatttttgtatacaatcccttaaaaagctctctcatatgtcagtagcctattataggcaatgctacagattaactaaccgaattccaaatgggtaagttaaaatcttcttataatttaattccaaacttctcttctataagaggagcaaaatccgaataaccgccaacgtgaacctcatctaaaaagatttgtggcacagtcgcaacaggtttacccacacgcggttctaaatcttgtttttcaataccttcagcgatcatatcgacaaatttaaaatcgaaatcaggtaattctgctttcattttttctgcaagctgttttgctcgaacgcaataagggcaacttaatctgccgtaaatttctacaaacatttttaatctcctataaattattaggggcattgttgcccctacttctcattacttcgtgctggtacttgtcgtggtacgacttgcacgtttacgttctacttcagtgagtaattttttacgaatacgcactgattttggtgttacttccactaactcgtcatcatcaataaattctaacgcttgttccaagctgaatttaactggcgttgttaaggttaaagcatcatctttacctgacgcacgcatattggtgagttttttcccttcaagcgggtttacggttaggtcatttgaacggctatggataccgattacctgtccttcataaatttctgcaccgtgatcgatcattaatttaccacgatcttgtagtgcatagagcgagtaagcaagggctttacctgtgccgtttgaaatcaatacgccgttaatacgctgaccaatttcacctgcttttacatcgtcatagtggctgaaacttgagtaaagtaagcctgtacctgatgtcatcgtcataaactcattacggaaaccgattaagccacggcttggaataatgtattctaaacgagtacgacctttaccatctgggatcatatcacgcacttcacctttacggataccaagcgcttccatcacagccccttgatgttgttcttcaatatcaatggtcacttgctcaaacggttcttgtttacgaccatcaatctctttgaaaattacttttggacgagataccgctaattcataaccttcacgacgcatattttcgattaatacagacaagtgcaattcaccacgacccgatacgctgaaaacatcagagtcatcagtttcttctacgcgtaatgcgacgttatgcactaactctttcttcaaacgctctaaaatttggcgtgaagtaacgaatttcccttcttgaccgcagaagggtgatgtgtttacacagaagaacattgttactgtcggctcatcaacagataaagctggaagtgcttcaacattgttgatgtcacataaggtatctgaaatgtttaattcgcctaaacctgtaatagcaatgatgtcaccagcataggcttcggttgcttcatagcgttgtaagcctaagtgacctaacacttgaccaacacgaccattacgggttttaccttctgcatcaatgacagtcacaggttggttaggtttaaccgtacctcgtttgatacgaccgataccgataacgcctagatatttgctgtaatctaactgtgaaatttgcatttggaacggtgcatcaagttcaacatctggcggagaaacttgccctacaatggcttcaaagagtggatccatatttgatgcaagatcttcgtgatctaaacctgcgacaccatttaatgcagaagcataaataatcgggaagtctagctgttcatcggttgcccccaagttcacgaataaatcgaaaacttgatccacaacccagtcaggacgagcacctgggcggtcaactttattgataaccacgataggttttaaaccgtgagcaaaggctttttgggttacgaaacgggtttgtggcattggaccatcaaaagcatcgaccacaagtaataccgagtccaccattgaaagtacacgctcaacttcaccaccgaagtctgcgtgtcctggggtatcgacgatattgatacgatagccgttccagttaattgcagtatttttcgcaagaatggtaatgccacgctctttctcaaggtcgttggagtccattacacgttcatctacatcaccacgagaggtatctaatgtgcctgaaagttttaataatttatcaaccagcgtggttttaccgtggtcaacgtgagcaatgattgcgatattacgcagtttttgagtatctaattgttgcattgaaataacttaattgtagggtggggctcgcccaccgagaataaaaatgatgagctaaagctcatctgacgaaatccaaaattgtgatgaagatcacaaaaagacgggtgattatacagaattttgattgaactgactagaaagcaagcggtttgtttgaagtaaaaatttgcaaattatttcgaataacttaccgcttgtatgaaaactcaggcttaaataggctataatccccacataattttatttattggagaatcgttatgcctttactagatagctttaaagtggatcacactcgtatgaacgctcctgcggtgcgtgttgcaaaaacaatgacaaccccgaagggagatacgattactgtgtttgatttgcgttttgtccgtccaaacattgagattttatcacctcgtggtattcatacgatggaacatttatttgctggttttatgcgtgatcatctcaatagcgataccgttgaaattattgatatttccccgatgggttgccgtacgggattttatatgtcgttaattggttcaccttcggctgaagaagtggcaaaagcgtgggaagcctctatgcgtgatgcgttagaaaaagtgcctgatgagtctaaaattcctgaattaaacgaatatcaatgtggctcttataaagaacactctttagctgatgcacacgaaattgcgcgtaatgtgttaaaacaaccgattggtattaaccgtaacgaagatttagcattagatgagaaattgctaaatccatagttattgctacggaactaacaatagtttcttttcaaatggtagggacgcactgagtgtgtccgctacatttatcacctttcaatttttactccccatcatacttataaggaaagctcgtgttaaataaattatttggttggtttgaaaatcgcattaatccttatccagaagatatgccgaatacacctcgagcaaaggttatttcttttatttttgaaagcatcaaaggaatgagaagctattttgtggcgttaatcatttttgttgcatttataggcattattgaagggattttgtttcagtatatgggcgagttggtggactgggtaaacacttattctgctcaacaattgtggcaagaaaaaggcacttctctgatattgatgctgattgtggcattgatgagtgtggtgtttgtctatctcggctgtgctgttcgctttcagtcgttacaaggggtatttccgatgcggttgcgttggaatttccaccgtttgatgctcggacaaagtatgagcttttatcaggacgagtttgctgggcgtgtatctgctaaggtgatgcaaacagcattagccgtgcgtgatgtgttgatgacctgtgcggatatgctggtctatgcgattgtgtatttgacgacaaccagtgtaattttgcttcagcttgatggctggctatttttgccttttattatttgggtagtcagtttggcaacgattatttggttatatgtgccaaaacttgctcaagcagctcaagagcaatccgatgctcgcagtttaatgacagggcgaattaccgacgcttattcaaacattgcgacagtgaagctgttttctcacggtaatcgagaatctcgctatgccaaagagtcgatggaagagtttatggtaacagtacataaacagatgcgtttagtgacaacgattgaaacattgacctattttagtagtatcgcattaattacgatcaccgcaggtattgggctatggctttggacgttaggtgaggtgacagcaggggcaatcgccacttctactgctttagcgttacgcattaaaggtctatcacaatggattatgtgggagtttgctagcttatttgaaaacttagggacagtacaagatggaatggaaactttatccaagccaagaacaattgtagataaagcagaggcaaaaccgcttgaagtggcacaaggtgaaattcgatttaatcaggttgattttgcctataatgcgaaaaagcctctactgaaaggctttgatttacatatcaaggcgggtgaaaaagtgggtttagtggggcgtagtggggcaggaaaatctactttaacgaatttgttgttacgtttttatgatgtgcaaaaaggctccgtggaaattgatgggcaaaacatttgtgatgtaacacaagaaagcctacgctcgcaaattggtttagtgacccaagacacctcattattacatcgttccgttcgagataatttgctttatggtcgtccaacggcgacagaagcagaaatgcttaaagccgttgagcgagcctctgcctctgattttattccgcttctcagtgatgctaaaggcagaacaggctatgatgcacacgtcggcgaacgaggcgtgaaactctcaggcggacaacgtcaacgtattgcgattgctcgtgtgatgttgaaagacgcaccgattttattattagatgaagcaaccagtgccttagactctgaagtggaagtcgctattcaagaaaatttgaccgaattaatggaagggaaaactgtcgttgccattgcacaccgtttatcgaccattatggcaatggatcgcttgattgtattagataaaggcgaaattgttgagcaaggtagtcacgaggaattattagctctcaatggtgtctatgcaaaactgtgggctcatcaaagtggtgggttcttgcaggaattacaggacgatatataagatagaagaactatttaaatcaaagagttggtaagaatcaggaatataattattaccaactttttgttttacagccctatggggttattcatactcttctaaccaaatcgttaaaatcgcttccaagatatgttcatttgacgcttctggatcatcctcaaaatcttccatctcacagatccatttatgcatatcagtaaaacgcacggtggttggatctaaatctgggttcatatcatacagattttctgcgatcattcttacatcagtccatttcattagtgtgctgcctcatttgcgtggtttaagttatattttggaatttcaacaacgagatcttcttcacccacaatacattgacaagacaagcggctgtcgatttctaagccccacgctttgtctaacatatcttcttcttgatctgatgtttcatttaagctgtcaaaaccttcacgaattacaacgtgacaagtagtgcaagcacaagaacagtcacaagcgtgatgaatttcaactcctgcattgtgagcaacttctaataagttttcacccgcttgagcttcaacaaccataccctctgggcaaaattcttcgtgtggaagaaaaacaatttttggcataatgtcctctaatatcttctgtttatttgtagggacacactgcgtgtgtccgttatttattttgcggacacacgcagtgtgtccctactggattttatcccatcacctcatcaaccgccttacctgctaaggctttttgaatggataaattcattcgtctagcggcaaattcttgggtggcaatatcaagatctttaataccttgctggatagcttggcgatctgttccttgttttgcgtaaatcaatttctgtaattccgcttcaatccctttaaattcatcaaccgaaagtagctctgcaccatcttcttgcaacgcaatgacaacgctatcaatcacacgatctgcctccacacgctgttccgccagctgacgggcttccatatcttgcttcgcattcgtcattgacgatttaatcatttcggtgacttcttcgtccgtcaaaccgtaagacggcttaatttggatagacgcttgcactttggttgatttttccattgcggtgacactcagtaacccgtccgcatcgacttgataagtcacgcgaatgtgtgccgcaccagcgaccatcggtggaataccacgcaaggtaaaacgtccaagtgaacggcaatcatcgactaactcacgttcaccttgtacaacatgaaccgtcatcgctgtctgcccatctttaaatgtggtgaactcttgtgcttttgccacaggaatagtggtattgcgaggaatgattttttccaccaatccgcccatcgtttcgatccctagcgaaagtggtacaacatctagcaacaacatttctgcatcaggcttattgccgactaaaatatccgcttgaatagctgcacccaacgccaccactttatcggggtcaatagaggttaatggcgttttgccgaaaaattcgcctacttgttcacgcacaaaaggtactctcgttgagccaccaaccatcacaacttcacgcacttcttgagcttctaccccagcatctttcaaggctcggcgacaagtcattaacgagcgttttacaagcggttggattagctcattaaattgcaaacggctgatttcaccctgccaatttgcaaattttgcagtaaaactgtccgcttgtgataagccaattttcacttgagtggcaagagtaagtagttcacgttgctgacttgctgtatttggctgaatacctgcttgttccgcaatccaattcgctaacagatgatcgaaatcatcgccacctaaagcggtatcgccacctgttgccaaaacttcaaatacaccacggctcaggcgtaaaatcgaaatatcaaaagtaccgccacctaagtcatatacagcaatcacgccttcttgaccgctatccaagccataagcaatagccgcagcagttggctcatttaataaacgcaatacattaagccccgccaaacgagaggcatctttggtactttgacgttgtgcatcatcaaaataggcaggcacagtaatcaccacgccagccaattcacccgccaagcgtttttctgcaaattgatttaagtgacttaaaatatcggcagacacttcaatcggacttttattgccttgtagcgtttgaattaacggcaagccgttatccgtcgcaacaaattgataaggtaaatttggataacgctgttcaacatctgccaaagaacgaccaattaaacgctttacagaaatcactgtatgttgcggatcagctactgcttgctcaaaggcttccacaccaacaactttattctcagcagcataatgtactaccgacggcactaacgcacgctctttctcatcaagtaatacctgagcttgtccgctacgcaccgttgctactaaagaatttgtcgtcccaaggtcaatccccaccgccaagcgatgttggtgcggcgctgccgtttgccctggttctgcaatttgaagtaatgacattttattatctctctatcatttattcccccctttgaaaaagggggggctaggggggatttttacaagatcattaaatccccctcaatccccctttttcaaaggggcaagtgtaatacttaattcaccgcataccccatatcatcaggctcaaatgtcgcttgataatggcgttcaatcggttgtttttgttttgtgtctaaatttataacttgattgccgtttaaatctgcaatctcagcttgccaattttcactacgcaggctgtggtaaaaactagcaatatcggcagttaatgcccagccgataaattgtgaataatttaagccaatactttcccatttctgctttttcgggtggaaataatgaactaaaccgactttttcgcctaatccgcccccgttcaccgcaaaataaccaccaatggcatcatcagcaatcagtaaatgaaacggtctttcgcccgattgttcaaaggttttaccaaaattccactcaaacaaaccgcgtggcagtttctcattacccgaacctaaaatgcgtaaccagccgtgatcgactaaaataccgcccgtttcataaattaccgcacccagtggcatacttgtcggtaactgcattcccaccaattctgcccctgcattttccacatctctcggcaggatttcataatggttattcgcttgcttgaaccaatcttgcataattgtccaagcggatttttgtttatcattcagctcttcgagggttttcatatttatttttctatgtagggacgccacgcgtggcgtccctactttcttttgtgcgaataccacacaattaaaattcaaacaacttctcttctactcgctcaatttttacttttttagtttcaatgtcgcttctaaaaaatgattaaaatcacttctgtaaatacgatcctgctttattctaaatttatcatattcctgttcagcttttaattttgccatttcgtgacttatttttcctttatctcgtaaaatcggataatttgataaagttaagaagctatctaaaaaagtttcccattctgccattgatgttaaaatttggcgagtagctctattctctgctaaatctaaataagctgaaaccaactgttctaactctttaatatgttgctcgcttaaataatttttagcaatactgacatcactctttaaaatttttccatccggtgcatttttccaagttgttaatcccatatttatagcttctgcatcggcttgtgtataaatcaactctgcagctgttttgcctgtaatcgcccaatgtaatttattttgaacagtggaaaaaaagcgttttgtatgggcggaagatttatcataatcactggctagagcataaatatcggtaatcttctcgtaaaatcgtcgctcagaagctctaatttcacgaatacgttcaacaagattagtaaaataatctaaaccaaactgtttaccttgtttcaaacgctcatcatcaagtacaaaaccttttaaaataaattcacgtaaaacttgagttgcccaaattcgaaattgtgttgcttcccgactgtttacacgatatccgacagcaataattgcatctaaattataaacattcgtcaaacgagtaacttggcgatgaccttcttgttgaactatttccattttggaaatggttgaaaattgaacaagttcccctgtgctatagatattatctaagtgtttagaaatagccggaacatcaacaccaaacaactcagccatacttttttgagaaagccaaaaagtctcatcttggtaaaagacattcacttttactgattcatcaggtgttgtatagaataatatattcgcactcgttggaatctgtaagttagacatgttaattcactcgtcaaataatcggatattttaattatggcgaatctgccataattaaaactcaaacaacttctcttctactcgttcaatttctaccaataattttttaataaaacgaagtttgtcgttaatggctagtgcatccgcccattgttgtgcattaagagcttgctcaagttgttgtaaaatggctttttgctgttgttcaatctcttgggcgaaagcggtgagatccgcttcgttttttgtggtttcaatgctttctaaggtttcacgccattccatttgttgcattaaaaacgccatatctcggttacttttttgctcaatatcttgctgttcacccgtatgaatagcgatgatcgcttcagcacgcaaaatcggatctttgagaatatgtaacgcatcattaatttccgccgatttctgcattgctaaacgctgttctgtcgcagaacttgccgcaaaattatcggggtgaagcgatttttgtaaggctaaataacgctcagacagttgagcattatctacttggaattgcacaggcagatcaaaaagcgtaaatggatttgacatcagaacctcttagacgttaaaactttcaccacaaccacattcattcttcacatttgggttgttgtacttaaatccttcgtttaatccttctttgacaaaatctaattctgtgccactgaggtaaacaaggcttttttcatctacaataattttaacaccgtgttgttcaaaaacgtgatcatcttcgtttaatacatcaacaaattcaaggacataagctaaccctgaacagcccgatgttttgacacccagccttaaaccgatgcctttgccacggttttcaaggaaggtacgaacacgatctgccgcggtttctgttagggtgatactcattttttctcctaatgaattgatttactaaaacgtttgtagggtgggtcttgacccaccattaataaaagagatggtgggttaaaacccaccctacaaccgctttaaacgcaagcggtcagattttgcaaattttttgcaaaaactaaccgcttgttagagattacttaccgtttttctctttgtaatctgcaatcgctgctttaattgcatcttctgcaagaattgagcagtgtacttttactggtggtaattcaagctcttctgcgatgtcgctgtttttgattgcttgagcttcatctaatgatttgccttttacccattcagtaattaatgagcttgatgcaatcgctgaaccgcaaccgtaagttttgaaacgagcatcttcaatgataccttgtttgttcactttaatttgaagttgcattacgtcaccacacgctggtgcgcccaccatacctgtaccgatatctgatgcttttttgtcgaatgaacctacgttacgtgggttttcatagtgatcaataactttatcgctgtatgccattttttaattcctctgttttattctgcccccgtttacgggggaagtggttgagcgaagcgaaaccgaagggggattgaatatatagaaaaatttacttgattatttgcccccatcaccttgcttcgcaaggtacttcccccattacatgggggaagaatttcattttaatgatgcgaccactcaattgagtttaagtcgataccttctttgaacatatcccaaagtggtgaaagttcgcgtaatttagttactgcttttttcacgatttcgatagtgtgatcgacctcttcttccgttgtccaacgaccgattgagaaacggattgagctgtgtgctaattcatcgtttaagcctaatgcacgaagtacataagatggctctaaacttgcagatgtacacgcagaacccgaagataccgcaatgtcttttaacgacatcatcattgactcaccttcaacgaagttaaagctgatgttcaagttgctatctacacgtttacctgcttccatcgtaccgttcacatacacttcttccatatctttgaaaccgttgtataaacggtcacgaagtgctttgatgcgtggcatttcagttaccatttcttcttttgcgatacgatatgcttcccccataccaacgatttggtgaacaggtaatgtacctgaacgcataccacgctcgtggccaccaccgtgaatgatcgcttctaaacgtacacgaggcttacggcaaacatataaaccgccgataccttttggcccgtaaagtttatggcttgagaaagacattaaatctacgtttaatgcttgaacatccacagggattttacctactgattgtgttgcatccacgtggaaaatgattttttttgcacggcagattttaccgatctcttcgattggttgaataacgccgatctcattgttcacctgcattacggagactaaaattgtgtctggacgaattgcagcttctaatttagcaatatccactaaacctgttgtttcaggctctaaataggtcacttcaaaaccttcacgctctaactgacggcacgtatctaataccgctttatgttcagttttaaccgtgatgatgtgtttacctttggtttggtagaaatgtgctgcacctttaattgccaggttgtcagactcggttgcacctgaagtgaatacgatttcacgagcatctgcaccgattaaatcagcgatttgattacgagctacatcaaccgcttcttctgcttcccaaccaaatttgtgagaacgagatgcagggttaccaaacacgccgtcctttgtcatatattccatcattttttttgcaacacgctcatcaacgggcgtagttgcggcataatccaaataaattggtaatttcattgttactcctaactaagagatttttataagattaatggtgatgatcgtggcagtgagaactctcacaatcgtgatcgctattttcttcaactaattcggctaaagttatcgtatgtaaatactgttcgatttgattttctaaacgctcccacaacgaatgggttaaacaacgactgttattactgcaattcccattgcctttacatttagatacatcaacactttcattcacagcggcaataatcaagctcacattaatttcctcaggcgtttttgctaactgatagccaccgccagggcctctcacactatgcacaagaccttctcggcgaagttgtgcaaaaagttgctctaaataagaaagtgaaatggcttggcgatctgaaatatctaccaaactcacaggcatatctttgccatgcaacgcaatatctaaaattgcagttacagcataacgtcctcgtgaagttaatttcatactcaaaccttttaaaaatgctcgattgttaagaaagaattctatataccctactaatttagtcaatatttctacacaaattaaatcaaaaggtttttttaatcaatttgctaatcttattcacataaacattattttaaagtttagataaaacactaagcggcgaaattctaaactatttttataaccatagttaaaatcccaccgcttacatcaagattacaaagttagcaactatttgtaatcatattgataataatcataacgattagaagccttacgttttataccattcaaaataaaacctttaataaagacccctgcacgttcaaaacgttctttagctaatccaacttctttaagtgtagtttcaccaaaacgcccaacaagtaaagatgttcctgcatacctaccaataatagctgcatctgtaacagccaaaataggcgctgtatccactatcactaaatcatattcttttgccgcccattctaatagtgcctgaaaacgagcattagatagtaattcagatggatttggtggagtttctcctttaacaataatatcaaaattatcataatgttgaatcacttgttcaaaaggaatttgctgtgcaatcacatcactcaatccaacctcttttgctaaacctaataatcgacgcaaataactccttcttaaatctgcatcaattaacaacaccttgtgcccagctttagcaagaacattagccaaattggttgaaataaaactttttcccacagacggagaagctccagaaatcattaatatattatttttagcttctaacattgcaaaatgcaaacttgtacgcaaactacgcaaagcctcaactgctggatctgtaggcgttgactccgacaataatttaaaatgctgaaccttatgcttagaaaaaataggctgttcatttgaatatggaatcatagcatacgttggcaagcctaacacatctaattcagatgttccctcaatacctctatgcagtagcgttttcgctatcgcagtaactgaggcaaagataagtcctaacataaatgccgaggcaaccacaatcatttttctaggtgaaacggcattaggcaaaacttgcgcctcatctaaaatacgaacatttcctaccgtactagccttaacaatttctaactcttgcattttattcaacaattgaatataaatttgctggtttacctccaaatctcgagttaaccgaataacctctttttgagtattaggtaaacgttctacttgtttatttaaacgaattttttcctcatttaatactttacgcttatcaatcaaagcaacataagcagggtgatttcgagtgaatttctgagaaatttcactctcctttaatgttaactcatttaaatctgcttctaactgaactatagtatctaatgctgatttagcttctagactgagatctactgattcattttttaagcggaattcattcaaattattctcagactctgccaaacgagctttaagttctggtaattgtttagacaaaaactctaaactcttagacgcttctgcagaatcacgaacaatattttgcagcaaataattttcagatacactctttactatcttcttaatttgagctttattctctccattaatagaaatttcaataatgcctgtctgcttaccactctctgttaccgaaatttgtttttgtaaagagttaattgctaacaacacatcattctttttaattttaaataattgtcctggcttagcctctaattcagaaatcgcaaacgaaaaatcttccgtttgatactttttcccaatgctcccttcaagaactttttcatctgcgaaaaataatgagaactctccagcattctccccaacctccaaaatcatctctttcatctgaggattcttaggctcaaataaagagagcgacaattgtggttcatatcccatcaaacgatgaagacctttactaagaaaagggatcgagaattgaggttcgactaccgtagttaaattaagttgctcaacagtattagataaaaccattcttgattttaaaattgcaatttcagtacttgaagatgattcaccctctaaaattcctgggaaatcgtttaaaagcccccttgaagatttactttctacttgaattgaagcattcgcagtgtaaacaggcggagctagtaaaacataagcaacaccaaataacgtcaccaacaatgtaaaaagagctatccaccacttataatctaataaagcccccaacaactttactaaatcaatttcatcatgattattttcattcatcttttaactgccttaaaattagagtttcaatttccatctcaatgctgcatcctcaatcaatgcataaacctctcggaacatatcttcactttgacgataaggatctggaatatctttattgctatccaaccaatgaccaaataacatgacttttccagaactttctggtgaaatttgtcgaaccaagtcaatatgacctttttccatgacaagaatcaagtctacattcttacatagttcagacgttaattgctgtgaacgatgttcagaaagatccactccacgagaaatagcaacttgttgcattgttggatctacaccttttccaactaaatggctacgctcagctgaaatacctgctgaaaaaatacgcttttcaggaaaatattgttttaataatttttctccgacgggggagcggcatatattaccgatacaaacaactaaaatacttccaaacattaattaccaattcctcactcttaagatagactctgttagattattgaaaccagataatgacggaacaacatgggcaatcactctattccaacgagttgctggcgctgttgtcacataaacaatgtcataaggttttaaataaaactctgttcctaatacataggaagttgcattagtcaaatccaattgataaatatctgcaatcttatctgttttttcagcttcatttgaaaccgttgacttatttacatcacgttgaccacgaataacaaaaatacccgttgcatctgcagataatttatcaattcccccactttgagcaattgcttcagttaacgtcataccataatgagtaattttcaacatctgaggttttgacacttcccccacaataaacaccttattcgcatcattgcgtggaatatgaaccacatcgccatcagataacaaacgattctgcgttaaattaccaaattgaatcaattctgctaaagagactttctcctctttgccatgacgagtaatagtcacattatgccaatccgcattatcagacaatcctccagccttatttacagcatctaacaaagttagaggaatattagttaaaaattgctgtcctggattcttgatttcgcctgttatatatgcttttttagattggtatgaggcaattgttacctcaatttgaggatcagtgacataggctgaaagagcttttgccaatttatcacgaacttgatttactgttaagccaacaacattaagctgcccaacatatggataaaagatagttccattagcatgcacttgattacctgattcagcggcagaacgataagcacccgcaggagttgtcaattcaggatgctcccaaactgtgacatttaatatgtcgccaacacctatcttatattgataacgcttaatttgttgttctaaaccaatgttatcacttgctttcaccgtacgaggagctaactgctttactaactgaggcgtaattaaataagcatccacaaccttcttaaagtccacattctctcccctcacttccgtatcaacaataggagaatgcgttgcagggaaaatcatcccacacccagaaagagataaaatcacaccagtaaaaacaagagctttagttaacttacacataatccatcttactcattttataattaacaaaatccatcagaatagtccaaaactcacacaccaaacgtcgaattgaacttgataaaaaccgtcctagtatacaacaaaccacatttatttgcacagaaaaacccaaaaagaaatattgatttgactcacacatgttgaggagtaataaatcttcactattctactatgcattctactacccaattcttattctcactgaatatatcaaaaaggaataggctaatctaaatatactatttatctacttgcatccgccaaacaaaatccactattttacttaccggagtatacccaattggaaaattcaacaaaatatcacgaattttatcgcattcattatgctgacaagccaattctaatttactaagtaaacttagtaactcatttaacggcagaaaatcttcttttgctgtcataatccgatgatgagctgttgtttcaacattatctccagcaattaataactcttcatagagtttctcaccaggtctaagcccagtaaacaaaatctcaatatcgccgtttggattatcctgatttttcactactaagcctgataattgaattagatttatcgccaaatcaacaatcttaacaggctcccccatatccaaaataaatacatcgccacctttcgccatcgctccagcttgaatgaccaattgagcagcttcaggaatggtcatgaaataacgaataacatttggatcagtcacagttactggcccccccttcagtatctgttccttaaataaaggaatcacagagccagatgaacctaacacattaccaaaacgaaccattgagaaaagtgtttgatgttcaatgccatctaaacaatttcctttttccattgccaacgcttgtaaacacaactcagcactacgttttgttgcccccatcacattagtaggacgcactgctttatcagttgaaatcagtacaaaagatttgacctgagcttcaatcgcagcacgagcagtatagtaagtaccaaaaatattattccgcacaccttcaaccatattgtactcaaccattggaacgtgtttataagctgccgcgtgatataccgtatccacttgataaacccgcataatttcaactaaatgcttaaagttccgaacgctccctaagagcggaataatttcaatatgacctaactgctgagttttaaccagtttgtttaattccctttcaattgaatataatccatattccgaaatctcaaataaaagtaatttacgaggctgattgcgaataatctgccgacaaagctcagaaccgatagaaccagcagcaccagtcaccatcacaatctgatgttgaatattcttacagaataactctggaataggttcaacgggttctctacctaacaaatcaatgatattaacctctttaacatcattgatagaaacactcccttcgacaattcgcgtcagtctcggaatctccataatttttacttttgaaccagataaaaattttacaatttcattttttcttgatctctcaacagaaggtaatgcaataataacttgctcaatttgataatctcgaaatttgtcaaacacattccgagccgaaaacacttttaaactctcaacacgagtattggcaaggttttcattatcatcaataaaaaatacaggcaaataatcatgggaacgaaatagcaatactgccaactgctgtcctgcagcacccgcaccataaattgcaattcgtttacgaggaacacccgcttgaagtacattctgaaccaaaatacgaattatacctcggctcaaatacacccaagagaacataaaaaagccaaacattaaaggaattgacataggaataacagcttgagtgctattacccaatacaaacaaagcaattaccgtaattaatgttgcaagaaataatctagaaattaatgtttcagaaaaagtatgtatgacaaaacgataaataccacaaacgatcaaacttgcaaccgcaatagcagaaactaaaagttcaccatacactaaccttgggattgaatctacatttaaatccaataaacgcaatacataagcaatccaaattaaaaatggaaacacacaaaaatcaataaataataaaataagttttttatatattctaggaatatatatcaatgaataaatcaatggcattaacatactgttatctcatcctatctctactgccttttcctaagacagttaagactatatatttaaaataatatttcagattcaggttttgatcatttctaaatctatttctacttgcatatgccccattacttcgacatactcttctgaggattcaccttgctcaacgagctatttaaacaactcagcgtaagttcttcagagtatttcatctgaataccccgtatcagaatatttttcaattttacttagagaaacattaaaacactcaaaaatatcttcaatatttctacctaaatgtttatagctaaatatcttgctattatttacttcagtagctaaataaaagttaagtttagatgataatccttctaccttgaaactatttttaaaaatgttcttagaatgagaacaaaatcactccatatgttatgattattaacataatcaatataatatttagctttcatcggcatgataatatcaatataggcttgacgaggattatcatatttacccaaaatttcactttcatcaaccatttcaatagaagcactatctgtaataccaggcttgacggataaaatttttattctatcttgctcagaatacagattcataaattcaggaatttcaggacgagggcctactaaactcatttttccaataaatacatctattaactgaggtaactcgtctaatttatactttcttagaactttccctgcattagtgatacgtttatcatctccaattgttaagctactttgtttttcggtattagccgccattgttctaaatttatgaattttaaataactgtccatttaatcctacacgaacctgcctaaaaaagacctctccatcagaatcttttttaatccaaatagcaataacaacaaaaacaggaaatagggcgacaagccctaatcctgaaaagaaaatatcaaacactctttttagcattacaaaatcccaattaagcgagtatttcacgaatagcgaggataactctttcttgatcttcttccgtcatcgcagtaaataaaggaatcgacacaattgaagcatatactttttcagcagcagggaaatcttccgggcttaaatgataggtatctcgccatacaggctgtttatgcaacgggataaagtgtactgaacagccaatgcctttttctgacattttaataataaattcatcacgagtaatgccacaatcttccttcaaacgaattggataaatatgccacgcatgtgttgagttgttttctgctttaggtggcaaaataataggcaaatcagataaggcttcctcatatttttttgccattaactctctcttttcccagaacttatcaatctttttaagctgttgtaaaccaattgccgaacaaatatcaggcaaattatatttgaatccaggttcaatgacttcatagtaccaagcaggtgttttagattgataacgatcaaatgcatctcgactaatcccgtgtaaacgcattatcttactacgctcaataatttgcttgtttttagaaacgagcataccgccttcacccgtcgtcatcgttttattcgcataaaaactaaatacagccacatcactatctagagttccgattaattttcctttatagaacgtagggaatgcgtgagctgaatcttcaacaacttttaaattgtattttttggcaatctctaaaatggtatccatatcacaagctagtccagcataatgaacaggaactattgcttttgttttggatgttatcgccttttcaattaatttaacatcgatattaagcgtatttggatcacaatcaacaaatatagggtgggcacctaaatatctcaccacttctgcagtcgcagtaaaagtgagtgtaggcacaataacttcatctccagctttaacaccaacagcctctagagcgagatgtaatccagatgttgcagaatttactgctaatgcttcaacaccatcacctatatatttagcaaaatcagcttcaaactgttttgttttaggacccgttgtaacccaacctgaacgtagggcatcaacaacttcattaatttcttcttcgccaatttcgggaagggcgaatggtagaaagttcatcatatcacctctatgcactaaactattatctaaaattattatataaaaactttttaacataacttggagaaagggccattaaaaagtaaagaacagcatacacattttctctcataccataccccaactcaggatttattttgaatagtcgatattttaacaaccctatgctttttttcatattagcccttctaaaatagaatgctttggtagatcgtctaaattttaatcctataataggcatattagaaaactgacattggtttttaaacccttcaaaccataacagggtatcctccgccaaatgtacatcatcactatatttagcaaccttattaaaaaatgaacgtcgaaacattgcagtaggatttgccaaaggatctctaaacccaaaaaatttatataattcttgatgagttaaaggaaaacgaacttcatccttaataatgaagtcattttcatcaatttcactaatccaagtaccaacaacatcaatagattgatttttatttaaatattcaacctgaaactgaaaacgttcaggagaagatatatcgtcactatccattttggcaatatatgttcctgaacaatattttaatccttcatttaaagctcttgctgtaccaacattcttgtctaatgaaataactattagctgtgatcctaatatagatttccaataatctatctcttgttctaaatctattggtacctccccgtctttaaccaaaataatttcatctggtttcaaggtttgctttgtcgaaatactttctattgccttagagaaatactccgctttatctttatggtatacagccattaagacagacaatttcatcaaaaacacctccaatttataactcaaaacttgccttagttggaaattttttattcagataatccatcagggcacctttgacctcattataattttcatcactaagataaggggaatcattaaaacaagcaaattttatattctgattcgactcaatagaatctatcatttctaacagcttttctattgatgacaaatttcgttctataccatcgtaatgttttttaggatagaagtcaccattcaacaaatgccaatagcgatacaaatattgagtcaagtctgacttatccctaaatttatttgcagagcaaattgacatttctttagaaaacagttctctaactaacaataaagttctcttattatatggttgaggatgatgccaatgttccaaccaaaaagcctttttatatatattaaaaaataaaaaattagagagtttatctttaactgaatacgactcatgataaagcatacttttatctattttttcaagattacattgactattaactaaatttaagttattgagcaatgaattaacccatacatctgaattcctaagccaaaaatatattttatttctagggaaccagccatgacttaaaaaatcaactggtttatcatgaaagaaaaagcgctctttattgacacccctcataataatcatatcatcatttaaatatacaaaattttcagatagagcatctatattacccaaattcatttcaattgaactggaattaaaaataggaaggtgttctttctcataataaagctgattatgtgtaattaaaaatattttttcattatttatatctaaccattcaggaaagtgtccctcagtaattaaatatattctattataccaagggcagtttttttctatagatcttagaacatatcttagagttcccatatctctatatcttgattcagaatttgaactagtttcttttaaatttatattactatagaaacttttttttgcctgccactctctatccagtgggtttacccaaggtagtacgaaatcaattttcatttactctcctatatattatcataaataatacattcattcctcagttaattcatcaggaatgttgatagcgttaaaatatcttttctttcttataaaataccaataaaccatacagttatgttattaactcttatttagctccataactaataaaaaaaataaaaggcaaattcaattaaattacttaaaatattattctcaatttaagaaattaataacatttccaatactgatgaaaacaaaaatgtaggcgcgatactaattagcacaaaaaataccctaattaaaaatctatttttttcctcttttatcctctcttctattgaagaatagatggagaataataagaatatcatacctaccattaaaattcttttggctgcaacatcacttaagaagaatactgaacaaatagctaacatccccacatataaatttatataaaaaaatcttaaagattcctctttaaatgagaacctatttaataaaacaaatataaaaaatacaacaaaaattacaactaaaaacaaaaatgatggaacatctccagaacctcgagtcgatttaccatcttgaaatataactgcaacaattatagccaccacagagctaataataagaagaaagatatttatacgtttttttatcaagaataagaggggaagaaatacccctgccatattatgagtaaaacatgctaatatgaacataaagttaaatgaaaatcgaaagttctttttatacagtaaaaagaaacaaaataaaaaaatcgtagctaaaaactgcctataaacatttaatattcccattacagaaggaaaaaataaaaaaacaataaaacaaaatatggttttaatttagcatggtagcaagaaagtacaagtacagtaaatgcaataatgtcgcagaataccagtactaaaatctcatttttaataaaactatacaaaactccactagaaacccaatacacaggttctctcaaaaaataaaaactagaaaaaaagctatctactccatatttcataacttccatatataccaatatatcctgttgaatagcataagtcctacataatatagaccaacatactaacaagataaaaagcaaaatatagcattgacgaaaagatttcttattttctgatttagaaaatatagaaagcaacaatgttgctataattaagaatatataaaatcccattaccataatagctatctctattggcatgtgtagtcaattacttctacaccaaatgatttcataatctcaaaatcttgaacaatttcatttctacaaatatctggtttaatgctaataatttttacattaggtaaattaataaaactaagaggagctccactatagaacgtataaatggtatattcgacattaagtctgaactgcgatacaaaataatcttcaaagattaatttactttttatataattaacaccatcaataataaacctctctcttggatgaggatagtaataatttatattaaatacctcaataatttttttgaccacacttaccccatcattaacagatataaatatcgaatctatcggttgccctaataacaaattaactctttctttggaggatgtcacttcatgtggagatatttttacaattccctctcgcattgatacataaactaatttatctttatcaactatattttccttattgtcataaattgtataatgtaccaatgacatttttctcaaatcttgcctagtataacgagaaaataacagtttcattataaggttaacacgaaatgaatcatttttataaaaaaaactgtttttaaaaatatttgctgtaccatcatcaaaggtatatagttcaaatttacctaatgaacttaaaagtaatctaatccatggattatcaaggtttgctatatacactttattaaattttttacataacaaaaaaccatatattcttactaaaactgacttatatagccgagaaaaatgattattaggagaaataaaacatttttttaagaaaaaaacattcttcttacaaagaactttttccatataatactgatatttatcattccagaccgaataaaatactagtaaatgaaaaatctcactctgttttttttcaactatcttctccgccattaacatttgaaatggagtcatacaaataatcaaattcatctaaccaactctctttgtcataaaatataacacaggcaaaatcccaccagctccaataacactcgcccaaggaatataactaatttccgtaaacattaatccacctagtgctactaaataaatccctgtcgataaaacagagcaatatgaaatctgttttgtttttccgtgatagaacaaataatttactaagaacaaatagggaataatcaaacttgttgaaagcaagaataatacgacatagtatttcactccctgaaactgttcgcctaacaaccataaaaagagttgttcggggattaatagtgttatcaatgaaggtattggcacaataaataatgaatatattacccatttttctaaatgttttaatgttactgtgccttgttttaatctttcaaataaataaggaactaatgctttgtttattgccaaaatgactaccgacaaaatactcgcaatttgtacccccatcgcatacaaaccaagatcagcttcgctaaatctgtgataaataaatatcctatctaactgtccttttataaagaaacttccgtgatgaaatatcattggaaatccgaaagcaattacataccataatgcgagcttatattgtgcgatattaaaaattttagtaaccgtctttcgcttataaataacataagctagagcagcaataaaaatattgctacatagtactgctaaaatacgcttttctaccaacgctgtttcatagatttctaacatgaacactgtgaatactgcattggttattgcagagcctaattgaatcagcgtataaggaagcgcttgtttttggcattgtcttatactaagttgtactactagaaatacttgaaatatgctacttaatactaaataaaacataatttcagattttgctacccaacaggcaattagccctaaagctcctatcgtaatagtataagcataccccgttgttaccactaaatctaaagaacgttttccatatcgataaaaatagcgggcaacagcaccatcttggcttagtccaataaaaatagcaaataatgctaaaaatgtttgataataagagagttctccaaatccttctacacctaattttctagataaatagggcagtaaaagaaaaggaattgattttgaaactaactctccaaatagatagattgcactatctttaataactttcattgtttaccaaactttcagcaagttgcagatccaatgttgtatcaatatcaatagagcggtaacttggcattaaataaaacttcacttcaggaataaagaaatttttttcttttaataaacttgcggtatcgttgatgtaaattgcaccatttgctctataagctttaggcaacgactgacgaggagcttcaaaatcgcttaattgattaataggcagaattttatgattttcatccaaaataaacgatttataagggtggtgttcacattcacatgctgacacgactgatttgcaatttcctgccaagaataattccatggcattacgaatatccaagcctgaacgtaatggactagttggttggaagtgtgcagtgataccttctgttaatccaagtgttgttacacaatgtaaaatggtatcaattgttctcgtatcactttgagctaattctacagggcggcgaaatggcattgctccatatttttctgcttcggcaagaattttatcaccatctgaggttacaataatttcgtcaaaagcctctgattcttgagcggctaaaatggctcgcccaactagagatattcctccaacaagttgtagattcttatctttgattccttttgaaccagctcttgctgggataatggctacttttttcatatttatctcctttacacgcccccatccccctcgctatcgctcggggacttcccccataaatgggggaagaatttttaccttcagactacattacttttttaatacttcccccgtttacgggggaaggtgcccgaagggcggatgggggaaatctctttgtatatttgtatacattcccctaatttcaatcacaactcatacaacccactcgtatcaaaactcaacgctggaaattttattgatgtaactacatcaccttccaccacaggttgcacacctatgtagcgtccgttttctagcacataaatttggatatgttgttcttcagggcggactatccaatattcacttacgccttgttcttgatagagttcgtatttgtctttcatctctctttttgaattacctggggagagaatttcaacgattagatctggcgcgccgatacagcctttttcgtccaatttattcgggtcacaaatgacacacaaatcgggttgcactaccgttttgattttgccattgctgtctggaaaacgaacatcaaagggagcaacatataattcacactgatgactatcaaaaacatctaagaatgcttttgttaatttcatcgaaatccgttgatgtaatcgattaggcgctggggacattgccattattttgcctttgataatttcaacgcgctcttgaaatttccattttaaataatcgccatagctataactgccgtttaaatctaattggctaagacttgtgatttcattcatattaagctccgaattgcctagctgtttatgtgagttttatctaatgctttttctatcttattcccaactcaaaaatcattgattcaacttggtagctaaatttaaaacaagcggtaagttgaatgccattttctgtagaaataatttcactgctaatttcgcaaggttcagattctgttgctcgagctttactggttaaaaatgctaaagcgtcttcagcttctgctttagtagtgtaaagttgagtaaaatttacagcacaatcactgttatcaataatagttcccacatcaacagaacagcaggaacttgaattacattcggacatatctgacctctaaagttgaactagataaacgccttacattctacaccttttcaacaacaacaacaacaacaacaacaacaacaacaacaacaacaacaagggattttcgaggtttaaatttacattttctacatctttttctgccgtttgactggtcggaactgtgcttgtttggaagaaatttcattgtacatctgaaataagcttcgtagaatccgcacgatttattttggtggtttgtaaaaatattctacaactcaccgcttacacttaatcaaaaaggattacctaatgaataaattcactaaaacagcacttgcttctatctttactttttctgcggcaggtgcttctgcagcagcattccaattagctgaggtgtcaacttctggtttgggtatggcgtatgctggtaatgcggcagttgcagataatgcttctgttgtagcaaccaacccagcattaatgactaaattcaaacaagtagaagtttctgttggtggagtttatgttgatgcggatgttaatgttgaaggttcttttggcactaaaacaacagtaaatggcaatgtaatagcttcatcacctgtctcagatgcaaatgcaaaagatattattccaagtgcaattgtgcctaatttatatgtggttgcaccagtttctgagcgttttgctgtgggtggtggtgttaatgttaactatggtttgaaatcagaattcccaacaaattatagcgcaggcgtatttgcaggtaaaactgagctaactgctgtaaactataacctaagcggagcttatgatcttggctacggatttagctttggcgtaggcttaaatgcagtacatgcaaaagcaacattagagcgccattttggtgctttaaatcctatggcaccgacagcgacagcaagtcgattaaaaggtgataaatggggatttggttggaatgtgggtctagcctatgatattaacgaaaacaaccgcctcggtgttgcataccattctccagtggatttacgtttcaaagggaaatatgtgggtactcaaagtgccaatgttgaaattccaggtcgcttaaaccttgagttaccagcatattgggaaatctcaggttatcataaacttactgagaaattggctgtacaatatagctataaaaagacacattggaatagcttccaagaacttcgtgcaatagataacaacggtaaagtgttgttacaaaaagatgaaaagttcaataataactctcgcattgcgttaggcgtgtcttatgatgtgattgaggcattaacattacgtgcaggtattgcttatgatgaaagtgcaagcgtggcacatccatctatctcaatccctgatacagatcgtacatggtacactttaggtgcaacttatcgctttaccccgaatttatctgttgacctctcttatgcgcatttacgtggtagcaaaaatacctttattgagagccaagtgttaggtgctcagcttcaaaatggtgctacagcagttacaagtgcagtgggtgaatttaaagttaaatcaactgctaacctttacggcttaaacgtaaactacaaattctaattttcatttgatgtaacctcaaaggcgtgtacactaagtggcacgtgtcagattattgccaaagtagcttgtagggtgggtcttgacccaccatatagccgtaacatattgattttattggtgggttaaaacccaccctacaatattcaatccatctaatatatggtttgtcagcagcctgaggtgtgtacactaagtgatacgcgtcagattattgctaaagtagcttgtagggtgggtcttgacccaccatatagccgtaacatattgattttattagtgggttaaaacccaccctacaatattcaatccatctaatatatggtttgtcagcagcctgaggtgtgtacactaagtgatacgcgtcagattattgctaaagtagcttgtagggtgggtcttgacccaccatatagccgtaacatattgattttattggtgggttaaaacccacctcccaatattcaatccatctaatatatggtttgtcagcaacctgaggcgtgtacactaagtggcacgccttttgttttaggataatcctatgaaatttcagatattctatcaattttatgattcgccagtggggagattgcttcttattgcaaaccaaacaggtttacttggcattgaatttgaacaagagcaacaaacacttaaccttcaacaatggaaaagttcagaacaggcaagcggtgaaattcaacaactattttgcaaaacagtgcaggtattagaccgctatttttcaggggaaaaagtagcattttgtcagttggattttttaaaccctcagggtactgcttttcagcaagcagtctgggaaatattgcttgagattccttatggtaaaacagtaagctacggcgatattgccaagcagttaaataatcctaacgccgttagagccgttggcggtgcagttggacgaaatccaatttcaattttaataccttgccaccgagtgttaggcaaaacgcaagcgcttactggttttggtggtgggcttcctactaaacgttatctacttgaattagaaggtatttcttatcaaaataaaggcactgaatttgtaaacccaaaacataaaaaatggacatcaatatgacaaagcacaacttagcaactcaacttgttcacgcagggcgaaaaaaacgttacacccaaggttctgtaaatagtgttattcaacgagcctcttcccttgtatttgattctgttgcagacaaaaaagaagccaccaaaaaccgctataaaggggctttattttacggcagacgtggcacactaactcattttgctctacaagatgcaatgtgtgaactagaaaatggagctggttgctacctttacccttgcggtgcagcggcggtcagtaatgcgattttatcctttgtacaacaaggcgatcacgttctaatgactggggcagcctatgaaccaacgcaagatttttgtcgtatcgtattgaagaaaatgggcgtttcaaccactttctatgatccattaattgcagaaggcattgcaacgcttattcagccaaataccaaagtgctttttctcgaatcaccaagttcattaacaatggaagttcctgatattccagcgattgttcgtacggcaagagcaataaatcctgaaattgtgattatgattgataatacttggtctgcaggcattctttttccagcccttgaacacggcattgatatttcgatccaagctggaacaaaataccttgtgggacattcggatacgatgattggtactgcggtttcaaatactcgctgttgggatcagctacgagagcactcttatttaatggggcaaatggttgatgcggattctgcttatgttaccgctcgtggcttacgcactttgggcattcgcttaaaacaacacgaagaaaatagtcttatcgttgctcaatggctggctcaacgtcctgaagtaaaagcagtttatcacccagcgctgccaagttgccctgggaacgcatattttaaacgtgattttaaaggttcaagcggtctattttcctttgaactttgtaaaactttatctaatgaagagcttgcgaattttctcgaccattttgagattttctcaatggcatattcttggggcggatttgagtcattaattttggcaaatcaacctaaagagattgaacgtattcgcccagccattgaacgtaaattaacagggacactcattcgtgttcatattggtttggaagatgtggaagatttgattgctgatcttgaagctgggcttgagcgaattacatcgtaaagatcttcagaatatatttgttttcataccttcccccgcttacggaggaaggttcccaaaaggctgatagggatttcaatgacggaagtgacgcattccagttagtaccattgccattccgtgttcgttggcggcgtcgatcacttcttgatctcgcattgagccacctgggtggataacgcaagtaataccgacttttgccgcggcatcaatgccgtcacggaatgggaagaaggcatcagatgccattacacagcctgccacttgtaagccttcgtcttccgctttgatccctgcgattttcgctgaataaactcggctcatttgtcctgcgccgataccaatcgtttgtttgtttttcgcatagacaatcgcattggatttgacatacttcgccactttccagcagaagagtaaatcgtctaattcttcttgggttggtttgcgttcagacacaaattgtaaatcttcaacagcaacttgcccttgatcggcatcttgaactaataagccaccattgacacgtttgaagtctaaacgtggttgtgcttcgctaaattcgccacattctaatacacgcacgtttttctttttcgctaaggcttctttggctgcttcagagatggttggggcgatgatcacttcaacaaactggcgatctgcaatcgtttgtgccgtttcgccatctaattcacggttaaaggcgataatgccaccaaaggcagaggttgggtcggtttggtaagctcggttgtaggcttctaaaatatctttgccaagagcaacaccgcaagggttggcgtgtttaacgatcacacaagctggctcgttaaattctttaacacattcaagggctgcgtcagtatcagcaatgttgttgtaagaaagggctttgccttgtagttgaactgcggttgctacagacgcttctttcagttcgttttcaacatagaatgcggcgttttggtggctgttttcaccgtaacgcattgtctgtttacgggtgaaatttaagtttaatgtgcgtgggaactgtccgcagacttgggtaatatcttcttcctcagtaccttgatatggtggtactttttgcccgaagtagttggcgatcattgcgtcgtattgagcggtgtgttcaaaggctttaattgcaaggttgaaacgggtttctaaggtgagtgagttttggttttgatccatttcagcaagaatagcgttaaagtcgttgttattgacgacaatcgcaacatctttatgatttttcgccgcagaacgcaccattgttggcccaccgatgtcgatattttcgaccgcatcttcaagggtgcagttcggtttagcaacggtggcggcaaatgggtagagattaaccacgaccatatcaattcgttcaatgttgtgttgtgccataatttcatcgtctgtgcctcggcgacctaagatcccaccgtgtactttcgggtgtagggttttaacacgtccgtccatcatttctgggaagcctgtgtagtccgatacttcggttacaggtaaaccgttgtctgcgagtaattttgctgttccgccggttgagagtagttttacaccacgttgaactaagccttgagcaaattcgacaatgcctgttttgtcagacacacttaataatgcttgttggattggacgatgagccattatgggttccttcgtgtattgattgaacgttaatcatcgatctcccctctttagcaaagaggggcagggggagatttggcagaagtgaatgacgaagaaaataagtaattaaagaaaaggaatacttgctttttatattgtgaagtttcactctctcacttcgattatgtcgtctgccaaatctcccctaacccctctttgctaaagagggggatccgatctgtggaatattttcggttaaattataacgcaatcgtttgcgtaaatccattatttacaaaacttgaactttagattttgcgaaaatctttttttctcagtaaaatgaacgaacgttcagtaactaatttgtttttttatgtttaaggatatttttcctcaaaatgaggtggcaatacgtattctcaatgcaacagataggttgatggcaaaagaaggggttcaaaatctttcgacccacaaaattgcaaaagaagctggggtatctgtgggtacgatctatctttattttaaggataaagagactttgcttaatcagcttgtgttgtatttgtttaatacgtttcattctgcggtagatcgggaatatgatcctgatttgcctctgtttgagcaatataaaaaattgtggaatgcaatttggcagtttatgttggataaccctaatattgttaaaaatatgcatcagtacgagtcgctaccacaatttcaagcgacaatggtggagtgtttgaatgcggattgggtgacgtggaataaatttgtcaagcaggggcaatcgcaaaatattattgcgaacttaccgccttttattttatttgcaattagtatgaaaacggcgtgggagttgatgtatcagcagttaatgttaaatcaaccttatgctcaagagatgcttgaagaagtgattatccgtacttggaaagcgattacgatttaatcaaaattgatatggagaaaatatgataataaatatgaaaaagacaacgaagggtaagcagtttgctattgttgtgaccttattggttgtgcttatcgtgtttggtggtgttgttggtatgcaacagtttatttcgatgaaaaaggctgaagctgcggcgaatatgcctgagcctgtgagcaatgtaacagtgatgaccgttaaaaatagagaatggacacctgttatttctgcggttggttctattcgtccgaatcaaggggctatgttaagttcacaggcggctggcacggtcactaaagttttggtgaagtctggcgataaagtgaaaaaaggtcagctattagttgaaattgatagcagtgcggaacaagccagtttgaaagcgacagaagctcagttatcgacagcgagagcaaactataatcgctatcgtaacttagtagcgtcaagcagtgcttcaaaagcggaatttgataatgccaaagcaacttatgagcaacttgtggcgactattgaggcgacaaaagctcagattgagcgtcgtcaaatttatgcgcctttcgacggtgaagcgggtattgtgaatgtgaatgtagggcaatatgtgacgattggcacaggaattgtgcgtgtggaagatcagtctgcgatgaaaattcgttttaccttacctcagactaacttagaagatatttttgttgggcaaaaagtgaccgcaagcattgatgctctacctgctcgtactttccctgcgaaaattaccgctatcgatcctgcggtggatacatcaacggggttaatcaatcttgaggcgatgataacagagggacaagagatgttgctttcaggtatgtttgctcgcttaaatgttgcattaccaaccttatacgatcaggttgttgtgccacaaattgcggttacttatacaatgtatggcgaaactgtttatgtgcttcaaccattatctgatgaagataaggaaaaagtgactaaaatggctgaaatgaacaaaagtttagacatcaataaaatctatcgtgctaaacagatggaagttacgacggctgaacgcagtggagtctattctcatttgagcaaaggcttaaaagccggtgatgtgattgtcactggtggcttacaacgtttaaaaaataacgccttaattcaaatttctgatgtacaacctgttggggttattgcaccagcgacaaaaacaaaactgtaatggggtaagctgtgaaatttaccgacatttttatcaaacgccccgtacttgctatctgtattagcctattgattacaatcttaggcttacagtctattagcaagctacaagtgcgtgaatatcctgagatgacgatctcaattgttactgtgagtgttaattatgcgggtgcagatgcaagtttaatgcaagctcttgttacgtcacaaattgaagaagctgttgcacaggcagataacatcgactatatgacttcatcaagttcaccaagtactacgacggtaacggcaaagatgaagttaaataccaatcctcaagaggcgttatcggatatttcttctaaagtaaatgcaattcgtggaagcttgcctagtggcattgatgatcctgctatcagcgtatcatcgggatcaaatgatgcgtttatgtatattcgttttacctctgatgatctttcatctccacaagttacggactacctaaatcgcgtggtgaaaccgcaattttttacgatcaatggggtgtctagcgttggtatctttggtggttcaacctttggcttacgcatttggttagatccagatagaatggctggctataacctttcaggtgcgaatgtgttatcggcattaagtgcaaataacctttcgacggcggcaggcagtgcaaatggttattacactgtctataaaaacaaggtgttatcgacaactccatcggtagaagagctggcaaatattactgtggcaaccaaagcagatggtatgcaaattaagttaaaagatattgcgaccgtagaactgaataaatcttcagataatgctcgagccacagcaaatggcaaagatgcggtggtgattgcccttgaagcctctgctacggcaaataaattaacggtggcaaaaaatatctatccgctgtttgcacaaattgagaaaaatctacccgcttccattaaagctgagattttgtatgacagcactattgcgattaatagctctatttctgaggtaattaaaaccattggtgaagcaacaatcattgtgcttattgtgattatcctattcttaggttcactccgtgcgatgattatccctgttatcactatcccgatttcattgattggggtgttattcttattacagatgcttgggttctcgatcaacttgctcaccttgctaggattgattttggcaattggtttggtggtagatgatgcgattgtggtattggaaaacgtagagcgtcacgttaaagagggtaaaacgccttttgatgcggcaattattgggacgcgtgagattgcattgcctgtcatttcaatgaccattactcttgcggcggtatattcaccgatggcattaatggaaggggttacaggatctctgtttaaagagtttgctttaacccttgctggtgctgtatttatttcggggattgcagcattaaccctttcgccgatgatgtctagccgtgtgttaaaagaacataaagagggtgaagaagggcgtttagtcaaatgcattcacgctatgttagataagatgacaagctgttatcaaaatatgctttcagcagtgatggcagtgcgtggctttatgctgttctttgcgattgctatttttgcgagcttaccgttcttgtttacttcattgtctagtgaggttgcaccttctgaagaccgtggtgttgtggttgcttttggctctggtcctgcaaatactaacttggattatacgcaggaagtgatgaaaccttttaatgagaaagtggttaaattgcctgaggttcacggcgcaatgtcgattgcaggctttaacggtggcaacagttcattgtcgattatctctttaaaagattggtctgaacgtagcaaatcgcagtttgaagtgaaagacattgttgcaggtatggcaaaacaagtggttggtatggatattaacgccgttgctttccctgaaattcagacaggtgaaagtgggctgccgttctcactggttattacgactgcagatagctatgaaaaacttgcagaagtcgccagtgaaattttagccaaagcacaagcgtcagggcaatttttcttcgctaacttagaccttaaatttaacacggcaacgatgaagatgaagtttgaccgtgaaaaaatggggacttatggcgtaacgatgcaacaggtgagtggcactttaggttcgttcttgtcgggggctatagttactcgtgttgatattgattccagagcttatccgattgtatcgcaagcggtgagaaatgaccgattaaatccagaaaatttaatgaactactatgtgacaacagcgagcggacaatctatcccattgggttcttttgtcacaatggaattaagtacagaaccagcttccctcagccgaatgaaccagcttaactcggcaacaattggcggtgtggtgtcgggttctattggtgatgccgtaaaatgggctgaagctgagttagctcgctccttgccatcaggctatcaatatgattttaaagctgaatctcgtcaatatatccaagagggtaacgcattaatgtttacctttgtgctggcagttgtgatgatttatatcgtcttagctattcagtttgaatcgtggcgtgatccgttggtgattttagtttctgttccgttagcaattagtggtgcattattggtgatgaatattttgggcattatgaaagtatcaggtgcaaccttgaatatttattctcaagtaggcttaatcaccctcgtaggcttgataacaaaacacggtatcttgatgtgtgaagtggcaaaagaagagcagttgcttcacggaaaatctcgccgtgatgctattttccacgctgcaactatccgcttgcgtccgattatgatgacgactgccgcgatgatcgcaggtcttattcctctgctttatgcttcaggagctggtgcaattgctcgctttagtattggtatggtgattgttgcaggtttaggtattggtacactctttacgctgtttgtattgcctgtgatctacacctatttaggcagtgagcataagccgttgagagagtttgatgaagcgaaatatgctaaggattaaactctaattcctgatgtagcggtaaaattaataagcaactcggtaagggttgcttatttttttgatagtgcagtagccaagacatagcgacatagtaaaaaggttaaagcctgatgaagctttaaccttttttaataaaagatgtaatttattggtgtaatagacaaaataaatattagcaacaattttgtccacttggcatagtttttgacgaatcagcaactattttatctactatgccaatttatcgtgactttggatactgtttttagaagaactcatgtaccttcttaaccataaataaaatggtataaccttatccaatatattgttcgatcaaatttcccatctccgaggtagttacgggcatcgtagtatgatcagcaagatctgccgtgcgataaccctcggctaatactttttgaaccgcattttcaatcgctttcgcagattcttccaaaccaaaactatgacgtaacatcatcgctgcagaaagaatttgtgcgattgggttagcaatatttttacctgcaatatctggcgctgaaccacccgctggttcgtataaaccaaatcctttttcatttagactcgcagaaggtaacatacccatagagccagtaatcatcgcacactcatcagaaataatatcgccaaagatattagagcaaagcaacacatcaaagaaatcaggttgcttgattaactgcattgtcgcattatcaatatagatatgatccaatttcacttcaggatattgttttgctacttcgtttacggtttcacgccaaagaattgaactcattaacacattggctttatcgacagaagtcacatgtttggtgcgtttcattgccgtttcaaatgccacttttgcgatacgttcaatttcataacggtgataaacttccgtatcaaaagctttctcattttctccctcgccttcacgacctttaggctgcccaaaatagataccacccgttaattcacggactgttaccatatcaaagccttttgctgcaatgtccgcacgcaatgggcaaaattgttctaagcctttataaagtgtagcagggcgaagattgcagaataatgcaaagtgtttacgaagtggtaacaaagcaccacgctctggttgctcatttggtggaagatgttcccattttggaccgcctacagagccaaacaaaatagcatcggcttcttcacacccttttaatgtgctttctggtaatgcttttccgtgattatcaatggcaacgccaccaatatcataatagttataatttaatttaaacccgtacttttgttgaacagtatcaagcactttaatcgcttgagccataatctcagggccaatcccgtcaccacttaacacggcaatgttgtagttttgcatataaatacctcaatatttgaaaatttataaaatataagttatattaataaaaataaataaaagaacaacattttttataaaaaataaatttttattattttttagaatttaaatctaaaaattaaagaaaacattgtttttaatgctagacaagcggtcagattttttgcaaaatgcccaacattgtttttatggtgtaaaccttatgttaattttgttggaggattcaatgaaaaaactctcaggagcggaaatgattgtgcaatccttgcgtgacgaaggcgtggaatacgtttttggttacccaggtggctcagttcttgatatttatgatgcaattcacaccttaggtggaatcaaacacgttctggttcgccacgaacaagcggctgtacatatggctgatggctatgcacgttctacaggtaaagtcggttgtgtattagtcacatctggcccaggggcaacaaatgcgatcacagggattgcaactgcctacacagattccattcctctggttgttttttcaggacaagtgccttcaagccttatcggaaccgatgctttccaagaatgtgatatggttggtatttctcgccctgtggttaaacatagtttcctcgtcaccaatccagaagaaattcctgagatcataaaaaaagcattttatatcgcttcaacaggtcgccctggccctgtcgttattgatgtgccaaaggatatggtaaatccagcaaataaattcagttaccactaccctgattctgtatcattacgttcttacaaccccacggtacaaggacacaaagggcaaattaagaaggcattaaaagcgatcttagtggctaaaaaacctgtactttttgtgggtggtggtgcagtgatttcggagtcaaataaagagttgatcgaatttgctcagaaattaaatctacctgtcacaagttctctaatgggattaggagcatatccaagtacagataagcaattcctaggtatgttaggtatgcacggtacctatgaagctaacaatgcaatgcacgaaagtgatttaattttgggtatcggtgtgcgttttgatgatcgtactaccaataatctcgcaaaatactgcccaaatgctaaagtgatccacattgatattgatcctacctctatttctaaaaccgtccctgcatatattcccattgtcggcgatgcaaaatttgtattagaagaatttttagcattgttaggtgaagaaaatctggcaaaaggtcaatcagatctgaccgcttggtggcaacaaattaatgagtggaaagctcgtcaatgtttacgttttgagcaaagtgatgtgattaaacctcaacaggttattcaaaccatttataaattaacaaatggcgatgcctatattgcttctgatgtaggacaacatcaaatgtttgctgcgttacattatcctttcgataaaccgcgtcgttggattaactctggtggtttaggcacaatgggctttggcttacctgcggctatgggagtgaaatttgcacaccctgaagcaacggttgtttgtgtcacaggtgacggcagtattcaaatgaatattcaagaactttctacagcaaaacaatatgatacccctgtggtgattgtgagtttaaacaaccgcttcttaggtatggtgaaacagtggcaggatattatttatgcaggtcgccattcccaatcttatatgaactcactacctgactttgtcaaactggcagaggcttatggacacgtcggtattcaaattaacacccctgatgaattagaggaaaaattagcacaagcctttgcaattaaagataaacttgtttttgttgatgtgttagtagatgaaacagaacacgtttacccaatgcaaattcgtggtgaatcaatgaaagatatgatgttaagtaaaacggagagaacagatgcgtagaatattatccgtcctattagaaaatgaatcgggagctttatcccgtgtcgttgggctattctctcaacgtggttttaatattgaaagtcttacggttgccccaacggatgatccgagtttatctcgaatgaccattgtggcacaaggtgatgaacaagtcttggagcagatagaaaaacaactgcataagctaattgatatattcaaagtgacaaatcttagccattgcgaacatattgagcgagaagtacttctactaaaagttcgagctgtaggtagtacacgagatgaaattaagcgaatggttgacattttccgtggacaaatcgtggacattacgccaaaacaatataccattcagctctctggtgctagtgataaactcaatgcttttattgaaacagtgaaagcagaaacaacaattattgaaatcgttcgttctggggtgattagtttggctcgaggggaaaaaaacagtttataaaattgattaaataaatagcatagtagatacaacatcaatcaatgtgagtacacacactttgagttaaaatcatttcctactatgcacttcacctaatataaatcaattaactaaacaatgcccaaatcggcttacagcttgaaggtaatatcaaatccttccctaactcaacccagcctgtcgggtagtggaaatctgagccgacagaggcatagagatcaaactcttttgcccaacgagcaagaagctgacgctggtctggcgtttgggcggctcccgttacctctatgccatctccgccagcctgtttaaactcttcaataaaacggcggatccatttcgctgttaatttatagcgtaatgggtgtgcaaaacagataacgccaccagcttggtgcgtcgctgcgatggcttcttcggtgctgcaccatacgggctttacataagccgttttgccgatccctagatagcgtttgaaggcgtgttcatcattgcgagcatagccttctgccacaagaaaacgggcgtaatgggcgcgagtaactgcaccgcttgcaagggcttttgccccttgatatgcgttagggatacctgctttggagagcttttcgccaatcaattcggctcgttcttggcgtaattgtttctggcgagcaagtaaattgacgatagcagggtgggtttcgtcaatatttaaggcagtgaggtgaaggcttttcccttcccataacacagaaatttctacaccactgataaaggtaagcggttggttttgggcaaacattttcgcttcagtgatacctgcgacggtatcgtgatcggttaaggctagcattgttacattttgttctaccgctcgtttaacgagttccgtgggggtaagcacgccatcggacgcagtgctatggctatgtaaatcatatttcatttaattatccttaatccctccaaccataacaatataccattttgtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttagcgttattggtttcggttttggtctttttctgatgggaaaaaccaatcacgaaattgcgtttagcaacatcaataccacaataaatcggagcgttcatcggtaacctgccttgtattcgggtttatatttcaactgttcggttttgctgatgaagttatccacgcctacgctacagaacgagttttagctctagggacacccaagctgtggataacgttatggtttatgttgctagtttactataattttaatatacaagggacacactgcgtgtgtccattcgttccaacaaaaaccgcaattcgtatcaacagacatacgttgacggacacacgcagtgtgtccctacgattattttctttattgttgtttttcacaagatttcacagaaacagaccattctgcccctgatttaattttgtatttgtccgcaaaattatccatatttaaggcgaaagagacattcaataggctattaaggtacatcaatggtctgccttcttcaacatcaccaaaactgctcttatatggcattgagccactataacgcactttgacctcatctgccgttgtttctttgatttcaacacagactttgccatctttttgaatacctgattgctcaagtaattcgtagctgatatttgtccaaacattgccatattgcatatccagcacaggaatgttgccttttaatgtgccttcttcaatagcaggtttttggtagccaatttcggtgactttggcaggtaactctgcaccgacttcttcaaaactgatctgcccggatgctaattttgcccctgtataagcatagacatcacgaccgtggaaagtataagatttttcagaaccttccaagcggtgttttgtttcatcaatttcacgaatgctcccaatcccgaaaaattctgccactaacgttaatgtgccattatctggggtcacaaaatagtgtcctgttttggtttttaatacgaccgatttacgatctgtgccaacccctggatcaacaacgctcacaaaaactgtgccagcaggccaataggttgcggtttggtataaacgataagaggcttcccaaatattatatgcaggaatttcgtgagttaagtcaaacatttttaactcgcgatcaaccccaaaagccaccccttgcattgcagatactgcaccatcttttaaaccgaagtctgtttgtaatacgagggcatttgcagcttttgtttccttagaagcgaccgcttgttttccgtttgttgttgcaaaagaagttgcagaaaaagccacaagggcaagagcaagtaatgttttattcatatcgttttccttatcgtcgtgtttgtaaaaattggagtgatagtaatcgtttgcctagccattgtctatagcgagaataagtttattttttattaagcaaagccccaatcgcttttaatttatccgctttactcagcccttgatcagcaagttgatttaattccgatactaatagctctgaagctggtgaattgacggatttggtggctttaggctgcattaattgtgctgcgtaagcggtgagatccgtcaataattttatcttgtcaggattatcgtgatattgagccgataacagatcaagtgcttgttcaaaggcctctgcttttgcttcaagttgttgatagcaatacttttgccaacgtacttgttctgcccgtgttaaggtttctgcgtagtgtcttgctcgataatggaaaagcagaggctcaattctaggatcgctaaatttcaaaccgtgatgtgcaagctcttcaggttttaggcttcgtaagattgccatattgtttttatctgcaggttcaaaaaagccatcgtataacgtggtttctatattatttgacgttggatagtttctttcttcagaaaaaatatcgagaaccttttctcgcacaaggtttttttgtgattttagccgttttaaattttctaaacaggctagacgatcaatgcctaaacgtgttgcattttcaggcagtaacgttttggctggagctaaaatcgggcatttattaatatgcacaagttttagtggaacagtataaagcccttgagcttctaattctgcttttttggtataaaggcgttcacgcaatatttcgcttggctcattcaataggtcgtttatattccccgatagatcacatacaatcactgcgtttcgattagtcgggtgccaagccaatggcacaacccaagcggtgttacctcgatagttgcctaacattccagaaacgtgaacaagcggtgtcatttcaccgacatcaatcatctcttctagggcttttttacctcgattttgcaggaaaaagtcgaataatttaggttgtttttgtttgattaactttgccattgcaatggtagcatacacatcagccattgcatcgtgagcgttgtcgtgagcaatgccatttgctttggtcaaattttctaatttaaagctcggcataccttcatcatcatacgcccattctatcccttctggacgtaaagcataacaggcacgcacaacatcaagaagatcccaacgagaattgccgtttttccagctatattcataaggatcgaaaaaattgcggaaaaaggtataacgggtcatttcatcatcatagcgaatgttgttatatcccatcacgcaggtgttaggttggctaaattcggcgtgaatacgagcggcaaattcaggttcaggtagcccttgttgattacaaagctgtggtgtaatccctgttaccatcacagcttctggtgaaggcaaataatcttctgtttgttggcagtagaacatcacgggttcaccgataatgttgaaatcgctatcggtgcggatccctgcaaattgtgcaggacgatctgtagcaggatcgacaccaaaactttcgtaatcgtaaataaaaaaggtggtttgaaccatttattcgcctcgttatctcattaatttattaattatttcaataagatataatttttttaaattttttagcattttattgaactaaattttattggggtagtcttagaatacgcataatgtgctagttttatttttcatttccttaggtaagacctcccccgatactgttttttggtatcgggtttttttatggtttcaaattatatttttataaacgtaattgtactttttggtaaacgtcgttgcgctccctttttccctgtgcaaccactttgattacaatacgttcatcaatcacttgatataccaaacgatagcctgcattacgcaatttgattttataacaatctttcattccacgaagtttagcactttctacacgcggattttcagctctttctttaagtttttcgataaattgttttcttaaatctaagcttagtttacggaactctttttctgctgatgggataaattcaatggtatagctcattttaataaatccgctaaatccactttgtagcttttttcgtgttggcgttcttccactaattttgctaattctgcatcatcagcaagctcaatgagatattcataaatatgcggtggtacacaataaaaagcgggttcatttcggtttaaaattgcaattgcctcaccgcctgccgcattgaatgtcgccattggatttgtctttagttctgtaatactcgcaacggtattggttaaaataacacttggcataataatccttcctttttttagtgccatttatcgctctttttatcggtcttgtcaaggttgttcataaagagagaagataaacaacagattattctgggtatctgtcttgttggctcttaagatcttaacccaacccctctctcaattaagcgataagcccaagtgtaaagcgctaggataaataagattaacactgcaaaagtatagtagatcgacacatcactaatacctaaaaaaccatagcgaaaaccgctgatcatataaacaatcgggttaaactgggacacttgttgccaaaattcaggcaataagctaatggaataaaacacaccgccaagataggttaagggggttagtataaaggttgggataatgccaatgtcatcaaaggtttttgcaaatacggcattaatcaatccccctagagcaaaggcaatagtcgtcatcaacatcgtaaggataatgatgccccaagagtatatttgataagaaacaaagcacaatgtcaccgctgtcacaaggataccgaccattacacctcgcattatactgcctgccacatatccccaaataatcgtatgggtagatagcggtgacacaagcaactcttcaatgttgcgaacaaatttgcttaggaaaaatgatgaagctgtgttggtgtaagaagcggtaattgctgacatcattattaacccaggggcaataaattgcatatagcttacaccgctcatctcaccgatacggtgtccgataagtttaccgaagatcaaaaaatagagtgtcgttgtaataattggcggtactaatgtttgtcgccaaatgcgtaagacacgttttgtttcttttactgcgagtgttgaaaatccgatcatatatttatctaattttattggctattttaattgcataaacaactcttccaagcggttggacttatttcgcatacttaacacttcaatatgttgtgaactaagctgttggaataagttgtttaacccttgttttcggtttacttctacttcgatagtggtttcatctacccatttaaacggataaccgtcaataacaagcggtcggttttcacttaaatctagcaaaaagatctccgtttcgagttttgccaataacgctttcattgaggtattctcgatgatttgcccttgctgaataattccgatattacggcacagagtttccgcttcttctaaatagtgcgtagtcagaataatggttgtcccttgctgattaagctctcgcaaaaaatcccacaaactacggcgaagttcaatatctacccctgctgtcggttcatctaaaatcagcagtttagggttatgcattaatgcacgggcaatcatcactcggcgtttcataccgcctgataattcacgggtaaaatgatcacgtttttcccataagtctaattttttcaaccaaatttccgcttggattaaggcttgactacgctcaatgccataaaatcctgcttggttaattaaaacgtcgatcactttttcaaactgattgaaattaaactcttggggaactaatccaatctgttgttttaattgaattttttgtttatcaagatcgtagccaaacacttttattgtcccacttgttttattcactagtgagctaataattccaatcgtcgtggacttgccagcaccattatgcccaagcaatgcataaaagtcgccctgttcaacacagagatctatgcctttaagggcttgaacacctgttggatattgtttgattagtttttttatttcgagtgcgtacatattttctactccgctactgcccgaatagttgcttcgtccatttgagcatcaaaggcttgttgtaaaagttttaacttttcgtccgcttgtagtgcttgtttagcctcttgcgtgagctgttcaaaaataactcgacgaatttctaatggggtttggaactcatcactttcgcctattcgcatttcactactaaagccttgttgtgagagggcattgtataaactttgggtcgcttcattgctgtttaaatgtgccattgtggggtttaaaaccaacaaaagatgattgttgttatggctttctaaatagctgtttaaagcgagctgacgagaaactccgcccagttttaaactgtttacaattcggctccatttatctcgttcacaaccaagctcaatcgtttttttaactagctcaggtgttcgctcttgcaaaatggcttgcttaatttctgaaggcttcggggcttcctcttgattttctaactcaggattaagccacgtccaacggtagtcttcatcattttgtgaagcgatagttttttgaggtgtttcttctatttgttgccgttgatcttgagcggtcactaggttcattaaaccttgctgaacgctctttttattcaccgtttggggtggttgaatgggagttaaatcagactttttttttcgtcttgttgctcttgtttcgcttttaattgctgacgagcttgcattgcttttaaggcaggcgatatgctttctgtattcgtttcagttggggaagcggttggttgagagagattttttgcaaaatgttgttcagttttgaccgcttgtgttgtcacagtttgagctgaattttgctgttgagctaaacgttctcttaactggctaatgctatttggcgattgcacaggtgcaacgggcgttgttggtgtaggtgtagcaacttttatcgtggttgcaatatttttagggtggaaagccaaggctcttaaaatagtcatttccacgcctgaacgttgctcaggggcaaaaggcaactcttttttgcctgtaagcattacttgatagaaaaactgcacatcttctggcgagatctgttttgctaaaaaatgcagtggggtttcttcttgatgtgcgtgttttaacaactgcaacatcgcaatttggtgcaaggtttctgccgtatcgcttaacagttgttgccaatcgacacctttttccgccacggactgaatcactgccattgctttttcaccgtcggcattcgcaagggcttgcaccaattctaacggttgatgatcgtcaattaagccgagcatctggcttacaatcggcaaggtgatattcacattactgacagcaattgcctgatcggttaagctcaacgcatcacgaatactgccttgtgccgcttttgctagtttagcaagtgctgacaattcgtagggaatttgctcttgggttaagataaattcaaggtgttgctgaatttgcgattgttccaacgcacgcaaatggaactgcatacaacgagaaagaatggtaatcggcagtttttgcggatccgtggtcgcaagtaagaatttgacatattcaggcggttcttcaagggtttttaataacgcattgaagctgtgacgagagagcatatgcacttcgtcaatcaaatagaccttaaaacgtccgacggttggtttgtattgcacattgtcgagcaattcacgggtatcttcgacttttgtgcgcgaagcagcgtcgatttcgatcagatcgataaatcgcccttcttcaatggctttacagttcgcacattgaccacaaggatcagcactgatccccgtttcacagttcaagcctttcgcaaacagacgagcaattgacgttttccctacgccacgcgttcccgaaaaaagataagcgtgatgtaaccgcccttctcgcaaaccattttcgagagcggataaaacgtgttgttgcccgaccacttcgctaaaccgctgtggtcgccatttgcgtgctagaacttgataggacatttgacctctttagatgttgcgtagctcttgaaatcccccctaaccccccttttacaaaggggggattgcaaagggagaaatataagattagtgaccttcaaagctcactaaggtataagaattgacaccgattttctctaagcgttctttaccgtcaagatcaggcaaccaaatcacaaaggctgcattctcaactgtaccacctaaacggcgaataagttgtactgttgcttccaccgtaccgcctgttgcaagtaaatcatcaatgacaagcacattatccccagcttgaacagagtctgtatggatctctaaggtatcttcgccgtactcaagggcataagattgcgaaattaccgcacgaggtaattttttcggtttgcgcacaagtacaaaaggcacacctaaagctaatgccactggcgcaccaaagataaatccacgagattcagcccccacaattttggtgatccctttatctttaaactcagccacaattgcatcaacagaggcttggaatgcggcaggcacttctaataaagaagtaatatcacggaagataatgcctgcttttggatagtcaggaatagatttaatggaagatttgattaactcaagttgttggttcattttttgaccttttaaacaagaaaaataacctgtggaatgtagcaaaatttgcaggaattacaaggaaaaaatgatagaagcggtcggttattgcaaaaaattttatattttgtagctgttccacaagaaaagaaatgtaggaacacaactcatcaagtattcctacaatatttaattagaaagcgccctatatttatatattatttacctcttccaacttgaccatcgctccttgaacagtatgttgaatttcaacggagatcaatcccctgatcaactcttcagtagattgaacttttgatacgatcgtatccccttcttcatcaaaatacccctgttctttcaatgtggcactaaaagtcgagaacaatgctttatcaaagaactctggagcattaataccgtgtagcacagacaggcgttgtgcaattgaacggctttcttgttcaagctcatttcgactaatttcaggttgctcaatcaaaatactcaagctgatgtaataacgttgtaataactcacggacacctgaagagtgtaactgcaacgaacggatacgctggcggttaatcacaaacatttcactttcgttcttaatcagattttgagcaacaaattccgctaaaattgcctcaatatgcccacgaacttcctctgctttaaagtgcataaagagttctgcttgtaagaacggataaatgcgatttacactctggataatcaaatctttagataccgtctcgtgatgtaacacaatacttgcgaccaatgatggcaaaacaaataaatgctgaatgttattgcgataataggtcattaatactgcagattgacgatctaaacggataatttcaccaaagttgtctttttctgagataacacctgaacgaggtaaattaataacgtgatctaacatcgcttcagctgtatccgttggcaaagtgacttccgctgtataaggtacatttttgaacagttgcatatagctttcaacctgctcaataagctgttcacgcgttaaagaacgttggcgtgaagcaagcaacacagagccaatgagattttttgcattgactgcggcggcattattaatatgcaccatcacttgtttagataccgcttcaacggcactatttaaccattttggacgaccattttcatctgtaagcggttctttccattcaggaaaatactgattgagatagtgattaagtggaataggttcgccaaaattcacatagccttgccctagttttttcagtttcttaatcacacgtaacaccaagccagcattctctttctctttctctgcacctcgtaattctttagcgtaagtatctacttctaaaacgtgttcataaccaatataaacaggcacaatgctgatcgggcgagttaagccacgttgcaatgcttgtaacgtcatcgacatcattcctgtttttggatcaagcaagcgccctgtgcgtgagcgaccgccctcaataaagtattctacggaataaccacggtagaacagctctgcaaggtattcacggaaaatcgtagaatacagacgattgcccttgaaagtacgacgaataaagaacgccccccaacttctaaaaataggacctgcaggccagaagtttaggttgatcccagcagcaatatgtggcggcactaagccttgatgatacagaatataagagagaagcagatagtccatatggctacggtggcacggcacatatactaactcgtgtccttctaatgccaatttacgcacacgctctgcatattgcacgttgatcccttgatagagtttattccacaaccaacttaacacacgatctgcgcttcttaagctgtcgtgacgaacatttgcagcgatttcatccagaattttctcagcttctttgcgagctttttcaagcgaactttttggttttttcgcttcatcttcaatcgcagccaaaattgcaggggattgcagtaacttattgaacatcgcttgacgatcaggcagttgagggcctgttgccgaataacgctgtttagcaaagtgcatttttgccacacgagccaatttttgagccagattttcatcggttccgtgattggtaatcatatagcgtaaagaaaccgcttgtgaaaaacggataaaattatcacgcccaaaccaaagcattgtcactaagcgttggaaagttcccagcagacgtaatactggcaaacctttctctttacctggcgctcgcccccatagcacagaaacaggcaccacttgaatgtctaactgctcatcattacggtttaaatctaaataacgatagaaaaccaactctgtttcacttttcgcccctttggatttaaagaaacgacgcccttcatctaaaaagacaaaacgaggcaaagataccccttgaatatcattatttaccagcggatcaggcaagttcagagcttggcagtttttttgcaaaattaacagatccgtttgtgaggtgtagggcaacacatacacaataggttgatctaacttcagccctaattcattcacaggatctgtaggaattgaacgtgttttcactaacagcgaaagcggtaggttcaatgctttacgatacaggtttaataacatagacatttttatatccttttatagttatgatcggattaaaacgatgcgcagtttagcataaatttcttaaggaaatctgagtttattcataaaagttgaggaataagaaagatattatatcgcattcgccccaaagcccattttaagagaataggtgtagggaacaatgccggaaccaacccaaaagaactgcctaaaaatccaccgtttgtcataaattccaacaaaaaaccgctgattacatcttgattgcattttgtttttttttgtacaattttgtcgtcttaaaaccatagtcaaaaggaaaacaaaatgacatttcgtaaaactctactctctaccttattactctcttttgccattgccagcaatgtttatgccgaaacagcagaagaaaaatttgaccgtgcaggtcaatatattcaacaacaaaattatcaagcagcttttccaatttttaaggaattggctgaacaaggtattaggactgctcaatatattttaggcttaatgttctccaatggagacggtgttcgccaagattatcatcaggcatttaaatggtttcaaaaagcggctgaacaaggagatgcaaaggctcaagctgcactggggtcaatgtataacctgggattgggagttcgacaaaatagctccaccgccaaaatgtggtttggaaaagcctgtgataatggcgaacaaggtgcttgttatttttatcgtaaactcagcgaatatggatactaattaacgtggaatctaataaaagtcatttttgggcggtggtcagtattctggctgctgcgttattggcgtttagtattgaagctgtttctaacaagtataaagcggaaggtgcttgggaagcagcgacttcagtgtttacgcttttgggggtattaatcacagcgggtacagttgtacctgctgtgttaagttatcaaagttttatcagagaatccgataatgcaaaaaaagaattggataacttaaagttagaatttgcaaaacatcaacgtaaaatcgaacaattatccgaaagagaagagcaaattattcaaacggtaacaagccgaaaagatgaacaattaattgaaaatattgcattaaataattcggtggatttagataattatgaagatttagagtgttcattaaaacgaaataaaagaaagcaaattttagccgaacttgctgaactttatttggagaaatttttggcatttaaagattgcctagatgaaggtgaattaactgaacgaggaaacgacaaatatttttcaagttggctaaaagaaataaagatttatcaacaattgagtgctgatagttctaagtttcagcaaaaatatataatttcattaagttatttattattggaattagataaaatgaagcgtaatagtgtgcaggaagatatttttaaccaagctaaacacttatttgcagatattaaagactttccccaaataagtttgtttaataaacagcatagtgtcgttgcagcagcaaaacaacgttttagtaagtattaaaaaataaattacagaatattcttaaattatcaattaataacattactcaacattaaaggattataaaatgaaaaaaacaaccaaaattttaaccgcactcactttactcgctgctgtttgtggcggtggatattattacacacagctttatcccgatcataaagatattagccgattagaaaccttaattcatcaaattgatttttatggtgataagttagctaaagcagaattagatattttcccaatcgatagattaaaacagcttgcggaaaaaaattatccgattgcacaatatcaattgggtaggtattatcggaaagaaaaaataaagaggaagcaaaaaaatggtttagccgtgcagcaaatcaaaactttgcaccagcatatagagcattagcttatacctatgattctgacagttatgaaagaaaaacatttttagctaaagcagcatcacttggagatatgccggcaaaatatgactataaaaatatccctatccctgtattagaagaattagctaaaatggattatcttcctgctcagctggatttaatcgatttctattttggtgataaagataaccataactgggaaaaggcattttattgggctgataaatattatgaaaatactaaaagatataattttaatatttacagaaatagttaccagagacttgccatattgtattatttaggtattggaacaaccccagatattgctaaagcggaaaaaatcttaacagaatatattgctttactagagaatcatgctcgcgatcaatattccaaagaagtttttaaggatattgaacacttaaaaatggaattagttgttcttaaagacaaagatgagatacttgataaagttgcccaagataaaatccaacagattagagaagaattacaggctaataatggtgctgaacgctttttcaaacaggcaaatgttttttttctagatatggatttaaaatattatgccaaagcctattttggcatttcttgcgatatgggaagccaagcaggttgtgataaatatgcagagatgaatacaaaataaacaaggacaccaagcgagctgtctttgcaatcatctcaactaatgaaaacggacacacgctgtgtgtccgtgccgttaattaagccaactccattcttcatttcttacagaaatctaaaattatttcgttgcaaatgaaattttactgtatataatgtcataaatttctgtatataaagacagtgaggaacttatgaaacgtcagcacctaacggctcgtcagcaagaaatctttgaatttgtgaaaaatcatattgaaagtacgggtatgccaccaactcgtgtagaaattgctcgtgaaattgggtttaaatcaccaaatgccgcagaagaacaccttaaagcccttgctcgtaaaggctatattgaaatgctttcagggacttcgcgtgggatccgtattttagtggaagatgaagcagcaaacgatgaagaaggtttgcctttaattggtaaagttgcagcaggtacgccgattgaagccattgaacatatcgaaaaacattatcctgtgaatggggcaatgttctcgccagctgccgattatcttcttaaggtgaatgggaactcaatggaaaaaattggcatattagacggtgatttacttgcagtgcataaaactaaatctgttcgtaatgggcaagtcgttgtcgcccgtgttgatgatgaagtcaccgtcaaacgcttagagaaaaaaggcgatttaatctatttacacccagaaaatgatgaattagagccgattgtcgtcgatcctcgtcaatcttatattgaaatcgaaggcattgccgtaggcgttattcgtagtaatgcgtggatgtaacctttcagatttctattgaaaaagtgttcagaaaaatccaaaataacgcctttcaaattttggctttacgaagagattatttatgaatttagcagaatttcatcaagcgattgaacaagtgtgggaacaaattgaagagcaacttgaagaacaaggttgcgatgtcgattgtgaaacacaaggggcggtttttaccattacttttgatgatgattcacaaattgtcattaacaagcaagaagcaatgcttgaactctggctggcaagcaaattaggtggttatcactttgcttaccgtgatggcgattgggtcagtgcggaagggcgttcattttggacacatttagaagaggctgtcgctcgtcacggcgaaacaatctcttttagctaatgtcagttacaccgcttgccaaagctgaaacggttttacataacgttttcggctaccaatctttccgacaaggtcaatcagaagtgattgaagcgatcttgtcgggtaaagattgcttggtgattatgacaacagggggcggaaaatccctttgttatcaagtgccagccctctgttttgaaggcataactctcgtgatctcacctttgatttcgctaatgaaggatcaggtagatcaactgcttatcaatggtgttgaagctggctatattaattccactcaaactattgaagaacagcaagcggttgaacaaaaagcgatttcaggacaactcaagctactttacctttcgcccgaaaaggtaatgacatccaattttttccaatttatctcattgtgcaaaattagcctgattgcggtcgatgaagcacattgcgtatctcaatggggacacgattttcgccctgaatacaccttgttaggcggtttgcgaaaaactttcccaaacataccgcttgttgcgctgactgcaacagcagatccgacaacccgttttgatattattcatcatcttaagctagaagatccccacacttatttaggaagttttgatcgtcctaacattcgctatacggtgcaagaaaaatttaaacctgtggatcaactgatcaaatttatcagcagtcagcaagggaaaagtgggattgtttattgtaatagccgtaaaaaagttgaagaactcacggaaaaactttcttctcaccgtttttctgtaatgggctatcacgcaggaatgacggtacaacaacgggaaaccgttcaaaatgcgtttcaacgagataatattcaaattgtcgttgctactgttgcctttggaatggggatcaacaaatccaatgtgcgttttgttgtgcattttgatctgccaagaagcattgaagcctattatcaagaaacagggcgagcagggagagatgatcttcctgcggaagcggtgttattttacgatcctgcggattatggttggctacacaaggtattactagaaaaaccagaaagtgaacaacgtcaaattgagcaacataaattgcaagccattggggcttttgccgaatcacaaacttgccgtcgccttgtgttactcaactattttggtgaaacacgccaagttgcttgtcaaaattgtgacatttgccttgatccaccgaaaaagtatgatggtttagttgatgcacaaaaagtgatgtctgttatttaccgcacgggacaacgcttcggcttacatcatattattgcagttcttcggggcttaaatcagcaaaaaatccgtgaatatcaacacgacactctatctgtctatgggattggcaaggataaatctcaagaatattggattagcgtaactcgccagctcattcatcttggctttattcgccaaaacattgttaatcattctgccctacaactcacagaacaagctcgccccattttacgcggtgaaacagccttggcactggcttccccacgtttaagtttttcagcaacagcttatgtgcagaaacagcaagctagcaagcggtatgataaagatctttttgcccgtttacgctttttacgcaaacagattgccgataaggaaaatattcccccttacgtcgttttcaatgacgctaccctacaagaaatggcagaatttatgccaacgacggcagatgaaatgctttccattaatggggtaggtgagagaaaactggataggtttggagaggcgtttttagggcttattagagagcatttatatcatatagaaagtattgtttgtgattaactttaggggctgtattagattagccctaaagttaaaatcaaactcttgcttcacatattacgatactatagtcgtaaaatatccaattaactcgtcctcactcaaaattttcactcccaattcctgtgcttttgccaattttgaaccagccttttcccctgcaatcaaataatccgttttacttgatacactgccagatactttacaacccaattgctgtaacaaggcttttgcttgatcacgggtgagctgtgttaatgtccctgtcagtactaccgttttatcttttaacggattgtcagcaatctcttgtggcaccacatcttgccacttcaccccttgagcaatcagatcttccacgacttcaatattatgtggttcttgccagaattggaataggcggtttgccaccacttccccaacatcttgtacctgttttagcgtgtctaaatccgcttggcgaatcgcatcaagagtaccaaagtgatttgcgagattttgtgcggtagattcgcccacatctcgaatacccaaagcaaataagaagcgggcaagggtggtattttttgccttttcgatactttgtagtgcattattggcagatttttctcccattcgctctaaacgcattaaggtggtgtgatcgagtttaaacagatctgccggggtatggatcagctcacgttccatcagttgttcaatcagtttttcacccacgccgtcaatatccattgctttgcgtgaaacgaaatgctttaacgcctctttacgttgggctccgcagaataatcccccagtacaacgagcaacagcttcgccctcaacacgtactacagctgagttacacacaggacaagcggttggaaaagcaattttttttgcattgtcaggacgacgttcagccacaacgcccacaatttgcggaataacatcacctgctcggcgaataatcacggtatccccaattgcgatccctaaacgctcaatctcatcaccgttatgtaaggtggcattgctcactgttaccccagctacaaagacgggctctaattttgccactggggtaattgcccctgttctgccgacctgaaattcaacatcgttcagaatcgtcatctcttcttgtgcagggaatttgtaagcaattgcccaacgaggtgcttttgagataaagccaagctgttcttgcaatgtaatctcattgactttcaacaccgtgccgtcaatgtcgtaacccagcgaactacgtttggcttggattttttgataaaacgcagtcaaggcttgagaacccgttgctaaggtaatttcagcattgacaggaatccccaaggtttttaaccacagcaagcggtcaaaatgtgtcgtagggagttcatcatcactttcataaaccccgatattatatgcgttcaacattaacgggcgttggctagtgattttcggatcgagctgacgaagtgaacctgccgctgcattacgaggattagcaaaggtcttctcaccttttgccagtgctttttcatttaactgctcaaatccttgctgtggcataaaaacttcaccacgcacttctaaacgatgcggaggattattggttttcagttttaacggaatattgcggatcgtgcggatattggcggtaatatcttcccctgttgttccgtcgccacgggttgcagcttgagttagtactccatcaacataaagaatactcaccgctaagccatcaagtttaggctcacaacaaaattcaatttgattactgttgatcgcaatacgatcttcaatacgacgcaaaaagcctgtgaggtcatcatctgaaaaggcgttatccagagaaagcattggaatttcgtgggtaatttgagcaaaaccatctaacggcttagcaccaacccgttgtgtcggtgaatcggacgtaatcaattcggggtgttgccattccagattttttaactcgttcatcaagcgatcatattctgcatcgggtacaagcggattatctaaaacgtggtagtggtattcatattcacgcaatttttcacgcaaatgttcaagttgggtttcaatagagtgtggcatctgtaaatttctcgataaaaaagaccgcttgcaagcggtcatatttaaacaatgtactgcaaattaattggctactcgtagtagataattttggcgagattcatcgttaaaaatttgatgttgttcatctaagacaaaaccgccaacagattgagcaaagctctctacggtacgaatcattaattttaaattagctagatcattacctactgaaggtaggtgcataaagaatactaatcccacggtagaaaactgttccattcttgctaaatcaaagactcctggttgcatcatattggccacgctgaacaatacagggcttgcaggattatctaaatgacggtggaagatctgatattcaccaaaatgaaaacctaacatttctaaattttgtacaatggcattaccttgaaattgaacgccttctggtgcaacaacatacaaagtgattatattatgctccgtagtttgttctattgtttcaacttgctctacttggacagtctgttcttgtatctgattttgttgatatgcttcagattgagattctggcatagactcttgatataaaggttgagatatttcttgagtttgtaaactaatacgaatatttttgacactattctcaacttcttgctgagattgaataaaatcagcaggtgtttcagtattgaatggttgctgagctacgacaccttgaggatttagcgttgttggaatatctgctgtaatttcattgctaattggagacgaaggtggacgagtagaaaaggtatttgaaaaaatacgagatttttctctgcgtgcagaccaaatactgtatccaattaaaacagcgattaataatcctgctaaaataaagaaaagaatatgagtttccattttgccctctttagctcataaaatcatcaaaattgaaatttaacactttgtgaaaatgtacgcatagcttaccatatttcttttaaaaaattgaatagaaaggttaatatgttgtcgttcttttcttcttttgattctgaaattaaagcaggttttcattattttatttatggttggcgtttaatgttacaacgtcagttaatgccatttattatttttcctgtgattatcaatgcagtgttgatgattagcctaatttggctcttttttgccaatgtagggggaatgttagattcgatcttgccttcgtggttagaatggttgagctttattcttattccattagcttttttaatgattttagtcgctttctactttgctttcaccactttagcgaattttattgctgccccatttaatgcgttactcgcagaaaaagttgagcaacaacttacgggtgaaaagctcacggaaatgagttttcatgaaatgttaaaagatgtacctcgtatgctcaaacgtgagtggcaaaaaatgtggtatagcattccacgtttggttgccttatttttattaggttttatacctgttttagggcagactattatccctatcttggcatttattttcggggcttggttaattgcaattcaatattgcgactacccttttgataaccataaaattcaatttcaacgtatgcgaaatgcattagcacaatatcgtacaatgaattttacttttggggctttggtaagtatttttacgatgttgccatttattaacttagtggtaatgcctgttgcggtgtgtggtgctacagcaatgtgggttaatgagtacaaaagagctctgcatgattaacggaaagccgacattaacagaggaactaatcttataaagcagtgcgtatgttttcttctcccaaaagactagttaagggagaggaaactttaagcatagactcggcacttagctattctaattctggctgctttcttccgaacctgaccaagtaaattaaagactactgcgagaagcccaaagtttcctcatagaaagacatctacatttatacagcagatgccctaattatatgagcttatctcaaagaagacaagaaaaatgtctattataaatagctatttcttacagggaatagctgttcaacaagactttaacttataaattaatcaccgcaaaaatcactaatacactataaagtgcagataaaccatagaaaatccaaccgcctgcaggaacgtgtactttaaaatcgtgcaagcctaggtggatacggtgcataccacaccacattgggaatattagtaatgctagaatagcgagtttaccgatccaagtgtgtgcgaatgcaatgatgttatctggtgtaattagtccaaatggcagtaagaaacctaagattaataccagcacagggaaaaagattgcactgatcgcaccgcctgcaccgaaaagtaaccatactaatggttcatttgaacgtggaggattgagtttgtccatttttgactccctatactaaaattaatgcaagaatgctgactacggcagtgattccccaaaagacgcgtgaaactaattttacgtcaatacgttcatttttgataatcacgttcatcatttgaggtgccataccgaagaaggtaaagctgtttagtaatactgcacctagagtgatgatgtttaagatcactaccactgggttttgtaagaaaccgacaaaagtggttgcaaaggtgcccttacctaaacagactagaccataaaatagcactaaacagaaccaaacggttggtacggaggtgctttcacgcaaaacgtagaatttgtaaaaatctaacgctttccaccaagttggtttgacttcacgcacatattttttgcgtttacttgctgctgttgtcattttactctctccttacttttgcggttttaacattgcaaagacataatctttggcactttcgatcttaccttggtttaccgcagaggccggaccaacgtgcttcggacagacttcagagcagtagccgacgaatgtacagctccatacaccgtttttaccgttgataattttcatacgttccgctttaccattgtcacggttatcaaggttgtaacggtgagctaaggttaatgctgctgggcctacaaattcagggtttaagccaaattgtgggcaagcggcataacataaaccacagttgatacacattgagaatgtacggtatttctcaagttgtgctggggtttgtttggtgcggcttttcgcaagctctgctgatgggtgtggtttgccatcaagttcaggggctttgttgtcaataatgtatggtttgatactttctaaactttcgatgaagtggcttaaatcaaccactaaatcacgttcaatcgggaagtttgcaagcggttcaattcgcatgtaaccgctgtaatcacgtaagaacgttttacatgccagttttggtttgccattgaccatcatgccgcaagagccgcagatcgccatacggcaagaccaacgatatgaaagctctggctctaattcatctttgatataaccaagtgcatcaagtaacgaagtttggctatcgtaaggcacttcatattttgataagtacggttcgttatcttgttcagggttataacgaagtacttctaccgtcattttacttgggttagtcatcttctgttactcctttttcgctgctgcttcttgtgcttccgcttctgcaccataaacacgtttagccggttgtgatgtggtaattttcacgtcgctgtatttgattgttggtgcgccgtctgcattgtagaatgcaagggtgtgttttaagtagttcacatcatcacgttcaacatagtctaaacgttggtgtgcaccacgagactctttacgttctaccgcagaagatgagatagattgtgctacgtcaaggatataaccaagttcaattttgtagagcaagtctgtattaaatacacttgagctgtcttttactttgatacgtttataacgctcttttaactctgcaatttttgccacggttttttccatactttcttgagtacgataaataccacaaccctcttccattgaatcccccatttcgttacggatttgtgaccaagactcttcaccctcttggcgtgctaaagcataaacacgttctaagacatcttttgcttgagagtcaattacggcttgattacgagcggtcgcttcaacagcacgttttgcagccatttcacctgcaactttaccgaataccacaagttctgctaatgagttagaacctaagcggtttgcaccgtgtaaaccagaagaagcacattcacccactgcaaataatcctttaatgcaggtttctgcgtgctgatcaacttcaataccacccattgtgtagtgaacaactggacgaactggaattggtgctttcgctggatctacgccttcgtaggcttttgctaattcacaaataaatggcagacgttcgtgtaaatatttttcacctaagtgacgtaggtcaagatgaaccacatcaacacctttggcagtttttaaggtgttacctttacgccactcttgccagaatgcttgggaaactttatcacgagggcctaattccatatatttattttctggtttgccaactggagtttctgggcctagaccataatcttgtaagtaacgataaccatctttattgactaagataccgccttcaccacgacaaccttcggtcattaagatacctgtgtttggtaagcctgttgggtgatattgtacaaattccatatcacgaagtggcacgccgtgacgataagccattgataaaccgtcacctgttacgataccgccgttggtgttgaaacgataagcacggcaaccaccacctgttgcgataactaccgcatttgcattgatctgaacaaaagttccttccatcatattcattgcaacacagccacgcgcttgaccatcatcaacgagaatatccacgacaaaatgctcatcaaaacggataatttgtggatatttaattgaggtttggaatagggtgtgtaataggtggaaacctgttttatcggctgcgaaccaagtacgttcaattttcataccaccgaaacggcgaacgttcacatcaccatcagctttacggctccacggacagccccaacgctctaattgggtcatttcaactggcgagtgttctacgaaatattcaacaacatcttgttcacaaagccagtcgccacctgccacagtatcgtggaagtgtttatcgtaagagtcttcctctttagcgactgccgccgccccaccttctgcagcaaccgtatggctacgcataggataaacttttgaaattaatgcaattttcaaattcgggttagcttctgctgctgcgattgcggctcttaaaccaccgccacctgcacccacaattgcaatatctacattgacagtttgcacgatttcctccttgggaaagtaaagtatataaacctaatatggaagcattttgccattaatttggatattttataatgaatttttacaattttgtaacacaaaaaaatagttttgtgatctatctcaaaaaataattttcagaatgctatgtagtgataattgatctcattaagtaggtgatttttaaggatatttgagcatttaatacggaaatatctttcactttattctcagattttcgtttgatttttagcatttcatctacataatgatgttgtgtaattgatagcgttctaaaatggaagaggatataccaatgcaatatttaaatgagtatattcttcaaaagtgagcttaaagccttgtactataaggctttagcccactttttaccaacacttttgtctactatgcaaaatatcctatctaaatcaccgctttcattagatttccgcctattatttctaacttttattgataaacgttgaaaaattcttgttattttattcttagttttgtgtaactcttgtttttttttttttttactaatagcgtgcggggacatttgtgcatcctgaaaatgtaaataaaggtttacgatgttttattaggaaaaacagtagagaaggttattatgaataaaatatttagagttatttggagtcatgctcaacaggcttgggtggttgtgtctgagttagtaaagtctcataccaaaacatccgcttgcacggataaaagagctcaagtatgcacctcagattattttttagataaacagcaagataaatttaaattaagtcttttaagtctagtattactaagtatattttttagtccagtaggtttagctgcatatcttcaagatagttctagtcaagggagtaaaggaagtgacggtggttctattggtattggtgaaggtagtaaggttgggcctggttctattgtcatcggtcagggcgcaaaagctgaaggtaggactgctgttgcgataggttattcagcaaagacaggttcagagcacgacaacgctattgcgataggcaacagctctacagcaactgggcctggaacagttaccgtggggcataattcagaagcgaaagataggtctgttgtcttaggcgcaaacgccaagggggaaggtgctcaaacagttgtaataggtacctttgctaaagcaagtgcgtcacaatctattgctatcggggcagatagcaaagcggaggggtatggctccatatcaatcggtggagatgatttagatcaaacggattatcacgataataataaaacaaactctccccgccacacaacaactgcgaaaggtaaagcctctgttgctattggggggctgtctttggctacgggcgacggttctactgttttaggtcctctagcatctgcaagtcatgttgaaggcattgctatcggtgcgagaagtaagtctaccaatgagtacggtattgcggttggtggtggtgcaactgctggaaaaaacgccgttgctgttggtagggactcgaacggtggtgggacagattccattgcgataggtaattctgcgaaaacaacaggggcagactctgttgttgtgggtgccaatatcaatgtgacaggtgaaaaattagtggcaattggacgcgaagcaaattctggaagtcattctactgccttgggttataaagcctctgccggtggtacgcactctgttgctgtgggtgaaagtgccacgacaaatgatggtgctgctagagcaaccgcacttggtaataataccgttgtcaccgtgggtggcggtgtggcattaggttatggctctaaggcagatacagctggcggtgtagaggggttaaaacaaactcattctgtcacaacgggaggaagcactgttgataacggctttaaatccacagaaaaggttgataataatgctattggtgcagtttctgtcggtggaggctcaggtgataaactcatcaatcgccaaatcgtcaatgtggcggctggtacacaagataccgatgcggtaaacgtggcacagcttaaatcgctcactatgaaaattgatggtgatagtaaaacagacacacctaaggttggcttgtggaagggtacgctgaaagtagtaggtacaagcggtgagattaagacttccgcaagcggtgataccatcacattgaaattagatgaaacattgaaaaacaaaattgataagattgacaatttaggttggaacctgaagattgcgaaaggggctggtgaagcaaatccacctaatgcagcacatcttatcaaaatgaacgagaccgtaacctttaccgctggaaataatattaaattagaacaaacgaacggaaatattacgatttctacgattggtaagttaattgcaaagactgaatgggaaaatgatggtttgaaaattacttatacggatggtatgcatgacattatcaagaaaggtgaaaaaggagatcgtggcgaaaaaggtccaaaaggcgatagaggagaaactggccctgcgggtccagcgggtccagcaggtgctcaaggttcagtaggtcctgcgggtccagtaggtccaactggaccacgaggtacacctggtcctgcaggaccaaaaggagaggcaggagcagctggacctaagggtgagaaaggtgatccaggaccaaaaggcgaaactggtccaacaggtccgaggggtccggcaggcccagcgggagagcgaggtcctgcgggtcctgcgggaccacaaggccctgcggggccaacgggacctaagggtgaaccgggtcctaaaggtgaacaaggtattccaggccctgcgggtccaacgggaccacaagacccttcgggtccaactggaaattcggaattaaaaggcattacgtcgattgccaatggtaacgacgccaccaaggcgaatggggctaagattaccttgtctgcaggttctacaaataaaacagttaatgttaatgatgcgaaaattaccaatgtggcggctggtacagcagatactgatgcggtgaatgtgagccagttaaatactaaggcagcagcggcgagaactgaggttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaatttctgataatggcaaatggcttattcgagcgtctgttagcagtaatactcagcgggatactatgattggaggaggggtaggttttgtgtggtaatctagcacctataaattagaatttcatgctcaatgccattgttattttaacaatggcattgtttggcatagtagataaaagtgttggttttaattatttttcctaattattaccaactctttttatttaaaaaatcctttataaacataatcttatgctttttcgttaatccattatgagccgataatttctgcttcagttctttaaataacccttccaacctatttgttgttttttctatatttaggtgagtatattcttcaaaagtgagcttaaagccttgtactataaggctttagcccactttttatcaacacttttgtctactatgcctattttgatctaaaatagagcttttagccattatctaggacaatcccaataaaaataaggcattatcttacaaaatattaaggctgcgaatcacagccttaataaattatgcttcttcaacagataaattttctataccgtcgtcttcaatttcacagattcgttcaaggctgacaacatgttcgtcttctgcggtacgaataatacgaacaccttgggtattacgtcctacaaggctgacttcgtttacacgggtacgtactaatgtaccggcatcggtaatcaacataatttggtcattttcttcaacctgaactgctgcaaccactttaccgttacgttcattcactttaattgaaaccaccccttttgttgcacgagatttgaccggatactcacctaaggcagtacgtttaccataaccgttttgggtaacggttaagatttcaccttgagtatgtggaattacaagggaaaccactttatcggtggttaagttaacacttgaggcttcttcagcttcttcgttttcaacagtttcaatatcgacttcttcagcatcatcgactgaaatttcggttgttgctaatttaatacctcgaacccctgttgcaacacgccccattccccgcactgcagtttctgcaaagcgtaccactcgaccttgcgccgagaacaacatgatttcactctcgccattggtaatatctaccccgattaattcatcaccctcgcgaagttttaatgcaattagaccgcttgatctaacattactaaatgcatcgagcgaaacttttttcaccgtaccactcgccgttgccataaaaataaatttatcagcgctaaattcaccatttggaacgggaagaattgcagtgatacgctcattctccccttttacaagtggaagaatatttacgattggcgtacctcttgcaccacggcttgcctgtggtaattgatagacttttaattgatataaacgaccacagcttgagaagcaaagaatggtatcatgagtattagctaccaataatttctcaatgaaatcatcctctttcattttcgttgctgatttacctttaccaccacgacgttgcgcttcgtaatccgataacggctgatatttcacataaccagcgtgcgataaggtcacaactacatcttcttgagcaattaaatcttctaaattaatatcgcctgaagccgcagtaatttcagtgcgacgctcatcgccaaattcggctttgattttttcaagctcttcacggatgacttccattaaacgctctgagctatttaaaatgtgtaataactcgctgatttctaccaataattctttgtattcgtctacgattttttcgtgttctaagcctgttaagcggtgcaagcgaagctctagaattgcacgagcttggacttccgataaataatattgcccgtcacgtacgccgaattcagaggctaaatcttctggacgagaagcatctacacccgctgcttcaagcattggtgcaacattacctaacgaccacggacgatccaataaaccttcacgtgcttcatcggcagttttggaatttcgaatcagctcaatcacaggatctatattggctaatgcaatcgctagaccttctaaaatatgtgcacgttcacgtgctttacgcaattcaaagaccgtacggcgtgttacaacttcacgacggtgcatcacgaaagcttcaataatctgtttgagattgaaaatttttggctgaccatgatcgagtgccaccatattgataccgaaagtcacttgcatttgtgttagagcgtacaaattattgagtaccacttcaccaacagcattatttttgatttcaataacaatcgaaatcccttttttatcagaatagtcttcaatacttgaaataccttcaatacgcttatcacgcaccaattcggcaattttttcgattaaattctttttattaacttgatacggcaattccgtgacgacaatctgctcacggccttttgaagttgtttcgacactggctttggctcgtacatacactttgccacgacctgtacgataagcatcttcaatccctttacgaccattaataatcgccgccgttgggaaatcaggaccgggaatatgttgcatcaactcttcaatcgtaatttgttcgttttcaatataagctaagcaaccgtttaacacttcatttaggttatgaggaggaatattggttgccatacccacggcgattcccgaagaaccattaacaagcaatgccggaattttagtcggtaatacatcagggatcatctctttaccatcatagtttggcgagaaatccactgtttctttatccaaatccgttaacaattcttgcgtaatcttctgcatacgcacttcggtataacgcattgccgcaggcgcatccccgtcaatcgaaccaaagttcccttgaccatctaccaacatataacgaagagagaacggctgagccatacgcacaatcgtattatacaccgcagaatcaccgtgagggtgatatttaccgatcacatcaccgactacacgtgccgatttcacataaggtttagatgatacgttaccgctttgatccatagaaaaaagtacgcgtcgatgaacgggcttcaaaccatctcgcacatctggtaacgctcgcccaacaatcacagacattgcataatcaagataggaattttttagttcctcttcaatactgataggaataatatctttagccaattcactcattaaaatttcctaattgcgttgtaaacatacctaattatttctataagctattcaattattaagtgaaaaccttctatagaaagaaggttaattataacattttaaataatcaacttcaatacaaaagttaattatttttaagataaaaaacatataaaatatattacgaacttacttttaatagtgataaatttagaattatttttaataggaggatcaataaatataagatataacatttaatatcaattttttatcaaagtattttcaatcataagaatataaaaccatttaaattaaagcatattccattacctaagtatcattttacagaaggaatcatgtcatttccagaatacaaaactctatgcgattatttaaaggaatataatttacgttattactttattgtaaggttcttaggaagcactggagctagaataagtgaactagtaaaattcacaatacaagatttagaaaaaggatatgctgaatgccattctaaaggaaaatttagaagaattaatattcctcaaagcctgattaatgaatctcgtgaatttttcaaaatcataaaaaagaattattcctgaatagatatggagcacctatttcagctagaggtattgctcataatttgaaaatatacgcagaaaagtgtggcatcagaaaagatgttgtccaccctcataattttaggcatttctttgctatacaatttttaaagaaaaataataatattgctttattagccgatctgttagggcattcaaatgtaaatatgactgctttatatctaagactatctcattcagaacaacgtgaggctataaataattcagtgaattggtaatttattatatactacttcatataggcttatttctatataaaaaatggcaatatagatttatatattgccatttccaatattactattttaattagcctttgtagttgtaaatgtgagcaactaagtctaatactttgtttgagtaaccagtttcgttgtcataccaagaaacaagtttcacgaatgtatctgttaatgcgatacctgcatctgcatcaaatacagaagtttcaactgcaccgttgaagtctgttgatactactgcatcttcagtataacctaaaacgccttttaattcgccgttgaatgttttaccttctgctgcatctttgatcgcttttttgatctcttcgtagcttgctggtttttctaagtttacagttaaatcaacaacagatacgtttgctgttggaacacggaacgccatacctgttaatttaccgtttaatgctggtaatactttacctactgctttcgctgcacctgttgaagatggaatgatgttttgtgccgcaccacgaccaccgcgccagtcttttgctgatggaccatcaacagttttttgtgttgctgttgttgcatgaacagttgtcattaaaccttctttgatgccaaatgtttcgtggataacacgagcaagtggtgctaagcagtttgttgtacaagaagcgttagaaacgatgtcttgaccagcataagcgttgaagtttacaccgtttacgaacataggtgtgctatctttagatggaccagttaaaacgacttttttcgcaccagcttcgatgtgtttacgagcagttgtatcgtctaagaataaacctgttgcttcaactgcgatatccacaccaatctcattccattttaagttagctgggtcacgctcagaagtaacacggatttctttaccgtttacaactaatttgccgtcttttacttcgacagtgccatcgaaacgaccgtgagttgaatcgtatttgagcatatatgccatatactcaacatcaattaagtcgttgataccaactacttcgatgtcatcacgtttttgtgctgcacggaatacgatacgaccgatacggccaaagccgttaataccaattttaattgccatagattttctacctatattaaagttaaacaaaatttgttctttcctagacattggaaaagcgagaggattataacacaatctttcccttttctgacaactaaagaacagagcaaaatatagcagataaattttatgtgatctatgtcaaattttttaaaaccctctcttgcttttaactaaaaaaagttagaataattggtaacaaaccaataagagaaaaggatttaaaatgattaaagatattagtgaattaaccgaagaacagattgaaatttgtttaaatgcaggtacagaaaaacctttcagtggtaagttcctaaaagaaaatagggtggggacatatcgctgtgttcgttgccataatgcgttatttcgttctgatgccaaatttgatgctggttgtggctggccaagtttttatgaaacgatctcggagtcttcattacgttatgtagatgattatagtttaggcagacatcgtgttgagattcgctgtggcaattgtgatgcccatatgggacacgtttttaaagatgggcctcaacctacaggattacgcttctgcttaaattctattgcattaaactttaagtgggatcaaaccggtgaagaaatagatgggtaaaataaagaataaaagtttctcggtataataaaaatgcccgcttttgcgggcattttttaagtttcttggattcaaaagtgattacatagaaacttcttttgaaccttgaacttggatttcaacacggcgatctggtgctaagcaagtgattaatgctttacgacctttaactgcgtcacatgtgttaccagttactgggttagcttcaccgtaacctaccgctgttacgttagctgggttaacacctttagaaacgatgtagtttgctactgtttctgcacgtttttgtgaaagagttaagttggcagcatctttaccaatacggtctgtgtaaccgtttacttgtacagcagggtttgctaaacctaaatttacgatctcagtgtgtactgcgtctaatgtttgtgctgcagctggttttaagtttgctttaccgaagtcaaataatacgtctgagctgaacgcgaagtttttagttacaacttctggtgctgctgcaactggtgctgcaccttgaccaaagcgatatgaaatacctgcggtcacagaatgagaatctgggctatagttgtaagttgctctacgattctctttcgcttcagctttagtgaagttacctacattgctcaaccattggtactcaacacggaatgctaattctggaagaattgcatactcaacacctgcacctaatactaaagaggtttttaagttatgagctttttgagtttgcactccagctgtttggctataacgtttgtaatcgttacgaactaatgcagcaccaactttaccgtaaacgtctaaaccgtttaatacttcatagcttggttttaagcttaagtgtgtaccgtgtgcagagtgtttgaatgcacggaattcttgtttgttaccacgaacacgaccgaaataatcgtaacctaattcaactgctaagttgtcaataatttggtaaccaccaaacacaccgtaagttacagagttacggctaatgccatattttaaattagtagcatcataacgtgcatcattagcatacttagagtcaatttggttaatatcattgtggaatgttgcccaaccagctttagcacctacatagaaagtgttagcttgtggagcagcttgagctacagaagcaactgctaaacctgatactgctaatgcaattaaagattttttcattttgatgatcctctattatcgtcatctaattaaacaaaattcttagcgtaatcattacgctaaggctttaactacgctttctattcttcaatacgaaaagaaagtcgaaatttcgcctacattttactaaaaaaaatccgaaatacaagcgaactttttcaaagaagccgtgccgaggctgaaatttcttacattcctgtcttttctttcttaaagaacgaggcaagaatgcaactattatcccattaatataaaagaaatcaatttataagcactcaaggaaatgtaagtaaatgtaataaattgcaactttttaaatgctttgccaatttttttgtagtaattttcattaaatgaaaatcttgctaagatctcgttaaaattttaacagatttaaaaactatgatcccacgccttgcaaacatacctcaacttaatccgcttgttcagaaatatttagctgaactcaaacagcaacatttcagtggtgatattgcgtcaaactatgctgatcgcctttctcttgccaccgacaacagcgtctatcagcaactgccccgagcgattttgtttccgaaatccgttgctgatgtggtgattttaaccaaactggcacaaaaaaccgcattccaagccttaacctttaccccgcgtggtggcggtactggcacgaacgggcaatcgctgaacaacaatatcattgttgatctctctcgccatttaacgcaaattttggaactgaatgtacaagagcgttgggtgcgagtgcaagctggcgtggtgaaagatcagcttaatcaatttctcaaaccgcacgggctattcttttcccctgagctttcaaccagcaaccgagcaaccttaggcggaatgatcaacacagacgcatcggggcaaggttcgttgcaatacggcaagacttccgatcatattttggcgattaaagcggtgttgatgaacggcgatattttggaaacacaagcggtcaaaaccgatgatttttttgcaaatgtcgatcaacttaatctcacggcgaatggcaaaaaattgcatagcgagatcttccaacgttgccaagcgttacgcccgaccgtgctgaaagaactaccgcaactgaaccgctttttgacgggttatgatctgaaaaatgtatttaacgacgttctctccgaatttaatttaacccgtattctaactggctccgaaggttctcttgcctttatttgcgaagctaagctcaatcttcttccgcttcctgaataccgcacgctgattaacattaaatataattcctttgatgcggcgttacgttccgccccttttatgttgcaagcccaagccctatcggttgaaacggtggactccaaagtgctgaaccttgccaaacaagatattgtgtggcattcggtgtcggatctgctcactgaagatgaacacaatccgattttggggattaacattgttgaatatgcttcaaatgataaggctcagaatgaagcgcggattgccaagctgtgccaagctctagatgaaaaaatccaagacggcacaagcggtatcatcggctaccaactttgcaacgatttggcttcgattgaaaaaatttatgcaatgcggaaaaaagcggtcggtttgctaggcaacgcaaaaggttgggcaaaaccgatcgctttcgtggaagatacctgcgtaccgcctgaacatttggcagattatattgtggaatttcgccaactgctcgacgatcacggcttagattacggtatgttcggacacgtcgatgcaggggtgttgcacgttcgtcctgcccttgatttatgcgacaaatcacaagttgccaaattcaaggcaatctccgaccaagtggttgaattgactgcaaaatacggcggtttgatttggggcgaacacggcaaaggtatgcgttctgcctatggtgagcggttctttggtgaaaccttatggaaagagttgcgttatatcaaacagcttttcgatccgcaaaaccgcttgaacccaggtaaaatctgtacgccgttagatagccaagccagcctttattcgattgattcgcaaatgcgtgccgatctagacagacaaattcctattcaagtgcgagaagcctttaaaggggcaatgaattgcaacggcaacggtttgtgcttcaattttgatgtacacagtacaatgtgtccgtcaatgaaagtgtcgggcaaccgcctattttcaccgaaaggaagagcaactttagtgcgtgaatggctacgtttactggcggaacaaaatgtttcccctgatgagttgatctttgaaaaacagcaaacatcggcgaaattagtcgattttgcgaagaaaatccgcaatcagtggcgaaaatcacaagagtatgatttctcccacgaagtgaaatcagcaatggatacttgccttgcttgtaaagcctgtgccagccaatgcccgataaaaattgatgtgccgacgttccgctcacaatttaacgaactctatcaccgccgttatctgcgtccgctgaaagattatgtggtggcgaacctcgaatttatcgcaccgataatggcaaaacagccgaagttgtttaacttcttcagtgccaacaaactggctgaaaccgttgcaagcaaaaccatcggaatggtcgatctgccggcgttatccgtgccgaccttacagcaacagttaattgaaatcggctatcaaggcaaaaccttagaagagctggaacagctggcgacaagcggtcaactagacacagaaatttgcaaatatgtccttgtggtgcaagatccgttcacctcttattatgatgccaaagtggtggcggattttgttcagctcgcccaaaaacttggcttcaaagcgattgtgttgccgttcaacccaacaggcaaagcacaacatatcaaaggctttttgcacaagtttgccaacaccgctcgcacacaagccgaattgttaaaccgtgttgccaaattaggcattgcaatggttggcgttgatcctgccttaaccttgatttaccgtgaagaataccgccaaattttaaaagacgactgtggcgaatttaaggtgttgctggctcacgaatggctgttggctcaactgaaaaacggcactctcgaccattgccaaaaatcagctgaaaccgaccgcttaccgtggcacttatttgcacactgtaccgaaagcacctcgctgccaaacagcttgaaagagtggcaacagattttcgcccatttcggcgaaaccttaacggcggaaaatatcggctgttgcggaatggcaggcacattcgggcacgaaaccaaacaccttgcaatgtcaaaagagatttacgcacaatcgtggcaagtgaagttacaaggcaaaaccttatcccgttgccttgccaccggttactcttgccgtagccaagtgaaacgaatggaacatcagctactcaaacaccctgtgcaagcgttgttggaagtgatttgacctagataaaaaataggcataaaataaaaacaggaacggcggtcaccgttcctgctcggtttcactgcttagcccgcactacccttaagtaacaggcatagcagaataacaattaaccacaaaagaatgcgtttcattgtttttatctccacggataacattaaacgtaaagatctactaaaacagcgcgctaggtgcttactggcggactgatttttcgcagatccgcctctgttttattatgtttaaacaataaaacattgggaaaaattatacataaagcctgtttatttgaacaggcttttgttttatctatatacggaaaataaaaatgatttggaaaaaaaacacaacgattgagcaacttaatcaactctgccaacactctgccatttcgcatttaggcattgaatttaccgctcaacaaaacgatagtctagaagcgaccgtacctgtcgatcatcgcacaacacagccattcggcttattacacggtggtatttctgcgactttagcggaaaccttaggctctgcagctgcattactttgttgtgaagaaaatcaaatccctgtcggcacagaattgaatatcagccatttaaaagcgataaaaagcggaaaagccacgggcagagcaacaccgttacatttaggtaaagagagccaagtgtggcaaatagaaattcgagatgatgcgcaacagttatgtgccgtggcaagattaagtactaagctactctcccaaagataaaacaaccccccaaacctttcgatttggggcttttcatttctcataatggtgggggaatccccacctataaatgattactcttcatcaccatcaaacccagtatttggcatagtagacaaaatagttgctgattcctcaaaaactatgccaagtggacaaaacagttgctaatatctattttctctaaatgttagcaactctttttatttaaaaaatcctgtataaacataatcttacgctttttccttaatccattatgattatttaattttcgtttaagttcactaaataatccctctaagcgatttgtcgtcttttctatatttaattcagtatgtttttcatagataaaaataaaatccatataacgctttaaactggcacaagcacttcttacattgcgatgtttataaggaaaatagcctttttcattcgctttatcactcctttcttttaaaaatgcttggtgttttatgaaccaagagtgtaatcgccgataaaattcattttttgagctttttgtgagtgtttttgcaattatttttaattctttacccgcttgtgattgatgttttttttcttaatttccgcatcacaattgccaccatatgaaattgacgcatctgtactggcgtattaaataaatctttcatcaaaccacgtctaccatcacaggtaatcgattgaattatatagcctttttctcttaacctattcagggcaagtttgtagtaaatatatttttcggttcgcacaaaataatgggaaatgacattatttgaaagcgtatccattaacactaatacgccaaaataacgacagaaaaacgttgtatccataatgatattcaggtatcgatttaaaggcggttttaaagctgttttagggactttatcaatatatctttgaatagttctgactaaacaatgatatttaacggcaagttgttgataggtttgttttccagatgtgtaatcagtccaaatcttaattgggtctaatttagtttttaagataaaagttttatggcatttatgacaaaaatatcgttgaatattatttgatgtaccacatttctttattttcagactttggcaaaatgggcagttttttgttcatatttcaaaaagaggcttaaagccttgtagtatagggctttaagccactttttagcaacaaatttgtctattacaccagtaaatatcgcataggacattaaagaaactgcaaccttattgaggagaattaattatccctcttatacagtaatgatttgattttttaatgtctgctattaatctcacggtcagagcaatctaaccgtgagatgttaatagctatactcagaaagactctaaaatataggagtttttaatatagaaactaagataggtgttctaaaaatgctggcaaattttgagcccctacttgttgagctacgacttctccatttttaaaaatcaataaaaatggaatactacgaacaccaaattctgctggaatctgctgattttcatcaacattcatcttcacaatacgagccttatttccaagatttatggctaaatcatctaatactggaccaattgctcggcaaggaccacaccaaggagcccaaaaatctaataatactgggacatccgattttaatacatcttgttcaaaagatgcgtcagttgtatgaattactctactcataatttttccttaactaaaataaaaaagaaacgcttctataacatctaaagcgttaagacgtgcacaagatagtgctttattcctgacttttcaagtaggaattaagtattaatgtaattaattttacctagcgtgctatgaagttttatacttagggaaatttccactatgtataagaatactaaacggcaaatcctcatatagttcggtgaataactaacacattgatacattatatcttatttacagcatttttatgggacatacctgttgatgcctttgtctacctcacaaatttaggagaatatccataggctaaataccccctcatacaccaatttccccccaaataaaataaacactgccccagcaaaattatctagatagcggttatatttggcataaaaatagcgaatagctggtcgagaaaatagcaaagcgacaagccagaaataaaccactgcactgcccactaaaatggcaagtaccgcaagtaagtccgctaatgcagagagattagcaacgtaaccggctaacacactgctgaaaaataccacaattttagggttggcaaggttaatcattaatccttttagaatttctttaacggttgaagttgcttgtgatgtcgatgttgccgagccaatttccgcatttttcgtgatttgcaccatttgaatgccgctataagcaagatagcttccgccacaaatcatcagcacaaattgaaatgaagggaaatgtttattgagaaatgccaagccaaacaaagtgagcaatgcccaaaatgcaacaccgatagagataccgatagcacctaaaatcgcatttcggcgagtatctgccattgctttacggctgacatagaaaaaatcaggaccagggctaattaagcccagtaattgtacgaaaaaaattgtccacattttaaatgcaccaagagatcaaatagagagtaataatcgagtagattgccgctaaaatatcatcaaacataatgcctaatccgccttgcagatgttcatcaaaatagcggatagggtagggtttgagaatatcaaacaagcggaaagtgacaaaggtcagcagataatagagccagttgtgttcaggcagaaaaccgaagatcacaaacaccgcaacgatctcgtcccagacgatccgcccatcatcgtgtacgccaagatcgtgactggttttgtcgcagatgtagcacccagcaacaaaagtgatcaagctcagtaacacaaaaaagagcgtgctttctgtgatgtgccacaacaagatcgccccccctaaaccagccaaagttccccaagtaccaggggcaggtttgattagccctgaaccaaagccgaatgcgagaaaatgaataggattttttaaatttatcttcattgttaattaaaatgatcaaagccaacttgattaggctgtggataaacagtgccgtgttttagtaaggttaaacgaccgcttgtttcggtgattttaccgatacaatggcaagaaatgcctaaatctgcaacggcttgttccattgcagaacgattgtcttccgatacggtaaaacagagttcataatcttccccacccgttaaagcaaattgttctgcctgttcttgtgaataagtttgtaacaatggtgctgaaaatggtaacttatccacattaatttccgcaccgcaaccacttcgttctaaaatatgccctaaatctgctaacaatccatcggaaatatcaatcgcacattgtgcatagttgagcaaacactgtcctaatgtcactctaggtgttgggcgtaaatggcgttgaattaagtagtgttgagcgtcggtcaatgtggctggcggattgagcaacagggctaaccctgccgagctatcgcctaaatgccctgaaacatagataagatcccccacctgtgctttatggcggaataatcctttgcctttaggcagaaagccttgtgcggtcaaggtgatcgccaagtgacccttggtggtatcaccgccgattaaagcggtttgatgctcggctaaaatagcaaaaagtgattggctaaagctatcaagccattgatgatcaacgtcggataaggttaatgccaaggaaacccaagcgggttttgcccccattgctgcgagatcgctcagattaaccgcaacggacttataagctaaatcagcaggggaaatcgtaggaagaaaatgtgtaccaagcactaaggtgtctgtggtaatggcgagctgatgatccgttggaatttctgtcaccgcacaatcatcgcccacggaaagtaaaatatcgtggcgatctaaccgcttgtcacgactaaaatagtgctttatcaaatcaaactcgcccattgtaatccttatttgcggttcaacgcaggggctaatttatctaatacgccattgacatatttgtggctatcgtcagaaccgaatacttttgccacttcaatcgcttcattaattgccactttgtaaggcacatctaattcaaattttagttcataaccggctaaacgtaagatagtacgttcaatcggatctaattcattatctgcacgatctaaatatggacgaagaatatcatcaataacatctacattttctaccgtaccgcgtaacaatttacggaaataaggcatatctacgccttgcatatcttgatcggtcacaaaggctaattcaacttgttcaatgctattttgcgaaatgtaccaagaataaagtgcttgcaccgcacattctctcgcacgacgacggggagaaactttcataaaacctcaatttatcgaaataaaaatagtcggcaattctaacacattgtagccttttcccgcaaaataaaggtgaagttatttctgcttttccgctcccattttttcagattttacaatataaggcgtaacaaaaatcactaattctcgtttagagattttatctcggttttggctaaataagcgtttaatcacggggatactgcctaacagcgggactttatcttcgcctttggcgatcagatgttgaaaaataccgcctaatacgatggtttcgccgtgtttagcaaggacttgtgtattaatttcttgtttatcaatcgttgccatcatattgttcatctggttatttggcgaattttggctaatggcaagatctaacaaaatctgattttgtttagaaatatgtggcgtgacttctagccccaaaaccgcttcacgaaattcaatatcggtgatttcctttttcttactgtacattgcataaggaatctctgtaccttgtttgatactcgctggttttttatctgttgtgagtaagcgagggcttgcaatgatctctatgttattttcgctttctaatgcggtgagttctaaatgaagtacacggctgttgatagcggcaatttgtaaggcaacagaagcggacggatttactggaaaatttacgtttaagttgttggtagttaatccgttgccttctaaattgcctgccaatttgtagtgattttcgttaggggaaaataagccccaacgcacgccaagttgttgtaaatgttcactgctgatcgtgacaattcgggcttcaattgcaatttgttccgttggtttatctagggtttcaataagttgagtaaagtttttaaccgatgcggcactgtctttgacgataatactattactgcgatcatcaaaatgaagataaccattctctgatagcaagttgccttgcccttttgtcaaagactctattacttcagaggctttggaatagtgtaacttgattgttttggtgattaatttaggcagagcattaactaattgtgccgtagtatgttgtttatgttcttgggcttgatgaatatagtaaatgccattttctttttttaaatttaattgatgtgttttgattaaactatttaatatctcatcaaaatggcttttttctactctgaaattttttgtatctttaatttcatctgaaatcgtaatattttttcccgtttcttcagctaaataaccaataatttctgccgtaggggcattttttatagaaagcgaaatttgttggtttgctaatacaggaaaagtagcaaagaatagcaggaataaataacgcataagatactcctaaaattttgaagtaaacaatttaggagattggcaattttctgttttttgccaatcaatataactaacagatttaaaatcaatctctttaatttgaataaaggaatggcttaaatagtcgttaggatataaatctataagctgttttttatcatctataaaaatcgctcgaattttatcgtcgatctgaataatgccgataagctgtaatttatcaaaatctgtggtgaggtgaatttcgttcaccttctctgttggcgtacaagcggtcgttttgttttgatcttttgccgtttgtggctgatcttgggcgttatccttagcataaaaaggatctgccatagtgacagcacttagaaagataaagtagaaaaagcataatcgcattagggttctcctgtgtcagcttgaaaaagtaaagtggcattgagttgaatatgtttctgttttgtttttttagttaaatggatttcctgaaatttaaccgtggttaattgattaagatcagcaatcacattaagtaccttttgcgtagattggctgattaataaatagatttttctttcttccatattccattgaatactgtcaatttctacgctgtttttatccaagattttttgaatttgttgatttatttgggttaataattcacttttatcttgagcaagttgataacgttgttgtaataattttaattgttgctgtttatgttcgttaatctgtttaaattcagtgagctgtttttgttgttgagctatttgctgattaagataaagataatttcctattggaaatgccataattaacaaaaatattcccgatagaataaatattttattttggtttaaataatataaaccacgatataatggatgttgtggcattaaataatacttggctaaggacaatttcattctttttcctttaaatcaatatgtaggctaaattcaatctcgcttttttcacgcgtttcaaattgttctatttgataaatgtaattcattgcttttaattgttgttcaagctcgctaaattgagtagggctagacactttgcctttgagtttaaagacggtattttctgcttggtatagttgggctatctcaataattcctgataattgaatgcctaacagataattcaaaaatgcggtaatctgcctattttctaggctttgtgtgcttttattttgtgattgcaaagtcagttgttcaatctgctggcttaatgcggtttgttgctcttggctttgttgtcgctgttgagccaaagtgtgaaattgatgttgttgctgttgattttgccaactgataagtaacgccagtagtgtgctaaccacaagacaagcggtgagatgcttgaggtttttttgcgactgtttcaaccattgctgttggcggtagccatttagattgatgccttgccattccataaacttgctcctaatgcaatgagataaggataaaagtggggaagatgttgagcttggggcaagccgtccacttcaatgattggtttggtgctattattctgcttttcgacgataattcgttgattttgaaagtgaataaatttgtcttgaatgtggaaactgtgttcaagaatttgcgtttccgtcatttttgtcagaaatcctaccgctcgtagcaggcagtagagttcgcaatctaaaatagctgttgggtcaaagctgttgctttttcttagggcatatagattaagctggcaaaggtggctttcggctaaaggggtaatgtggtaatcaatgtttacttcagataaagctaaaggtaggctctgtttgagtacacgaatgatttgctcagcttgttttaaatgggaatgtagctctggcagtattaaggtttttcgccagatatgctgatgagaaatgccttgaataagctgatagttaaagggaaattgttgtaggaaactatccgcttctactttgcttgaaaagtaaaaggtgtgaggttgttcttgctcaaaatagacgatacaagcggtattttcttgccagaaaaagccaacttgaataggtttgagttgcggtgttgtacgaaattgaaagaatttacccatatttccctcgaataaaaaatagattatgaggtcaattaaaactataattactcgtttctacctcactgatgtataagcagagggcagttttcggatttaggttatcttgacctagaattatcctttcgtcatttagcaaaagagaatttttcgatgaagatcgtaaaaatcatatttagtgctttacttacactaataattgtgggtctagttgctgtaggttttctttatgttcatttaaaagaagatttacctgatgtagcaagcctaaaaaccgttgaacttcaacaacctatgcagatttttaccgctgacggtaaactcattggggaagtcggggagcaacgccgtattcctgtgaaacttgccgatattccgcaaaccttaattgatgcgattattgcgacagaagatacccgtttttatgaacataaggggatcgatcctaaaggtattatgcgtgccgtttggcgttcaagccaaggagatacgcaaggggcgagtaccattacacaacagttagcacgcaactttttcctttcgccagaacgcaaacttgagcgtaaattaaaagaagtgattttggcgttagaaattgaagaaaatctgtctaagaatgagattttagagttatatctcaataaaatttacttggggtatcgctcttatggggtggcggctgcggctaaaacctattttggtaaaaagctagaagaattaaccttatcggaaatggcgatcattgcagggctaccaaaagccccttccacgatgaaccctcttttctcgcttaaacgagcagaagctcgtcgtaatgtagtgcttgggcgtatgttagaagtcggaaaaatcaccaaagcgcagtatgaacaggctaaagcagaaccgattaaagccaaatattacggcgctgcattagaatttcgcgccgactatgtgacagaaatgatccgtcaagaaatggtaaaacgttatggtgaagaagtcgcttacaccaaaggtttccaagtgtttgcaacagtgttatcagctgaccaaaaagaagcacaagatgcactacgcaataacttgattgactacgaccgccgtcacggctggcgtggagctgagaaactgtggaaccctaaagagaatgcgtgggacgaagaaaagatcatcgatcacttaagcaaattgccaagctctgagccatttacgagtgcggcagtattggcaatttcaaaagataaagcaaatgtgatgttgccaacaggggaacgtgttgagcttaagatgtctggaatgcgttgggcaagaaaatttatcaatgactccgcccaaggcaaagcacctactcaagtaaaagacgtgatcaatgttggtgaacaaatttgggtgcatcaaaatagtaagggtgaatgggaattagggcaaattccagatgtaaactctgcactggtttcactaaatagtgataacggggcgatagaagcgattgtgggcggtttcagttttgaacaaagccgttttaatcgtgcaacacaatctttagtgcaagtgggttcttcgattaaaccttttatctatgctgcagcattaaataaagggttgagcctttcaaccactctaagcgacacgcctattactattacaaaagcaggacaaaaaccgtggacaccgaaaaattcaccgaatgtgtatgaaggttcgttacgtttgcgagtaggcttgggtaagtcgaaaaatgtgatgatggtgcgtacagttcagatggctggcgtagagtatgtagcggattacttacaacgctttggcttccaaaaagatcaatatcaagcgacagaagcattggcattaggggcagcgtccttcacgccgttagaaatggctaggggatatgctgtgtttgataatggtggctatttgattgaaccttatatcattggtcgtattttagatagtacaggcaatgaactctttaaagcaaaccctgcaattgcctgtttagagtgtgatgataagccagtcatttatccagagccaacctattttgattttgtcaaagtaaaggaaactacagaagaaaccgcaattcctaaagatgatgaaagtgatgttattcctgaactggatattgccactaaaaccaaacaaaatgccccaagcttgatggcagatgccatagctgttaatcgagaagtgcattatgccccaagggttatcagtggggaaattgcattcttaatgcgaagtgcattgaaaacagctattacaggtgaagctagtcaaggttggaaaggaacaagctggcgtgtggcaaatgagatcaaacgcagtgatattggtggaaaaacagggactacaaataacgccaagatcgcttggtacgcaggctttggctcaaacctcgtgacgacagtttatgttggttttgatgataataaacgtgaattgggacgtggtgaggctggcgctcaaacagcgttgccagcgtggattaagtatatgaaagtggctctttcggataaagaagagcgaaaagaacagttgccacctaatatcatagaattacaaattgagcctacaagcggtctattagggggaaatatgagcgaatatttcattaaaggaactgaacctaagaaacgttatattgtagagaaggcacttgaacaacctctaggtacaaatcctgaaggaactgaaaaaatcagtaaagaattattctaaaattcgataattctctttgttccagttgaaaagtagggcgatttattgagataatatcgcccatctttattttgggcgatttgtggtaaatttataagataagtgttttaattttaatcacttttacaaaattcaacataaaacagaccgcttgtatgtgcaagcggtctgttttttctaaaaattcacaaatcaatttttcactctatttttatttatagaacaaataatggcagaaaaacgtaatatctttctaattggccctatgggtgcaggtaaaagcacgattggtcgtcaattagcacaaatgttaaatatggattttttagactcagacgctgtgattgaagagcgtgctggggcggatattgattggatcttcgatattgaaggcgaaacggggttccgtaaacgtgaagagcgtatcattaatgagctgacacaatctcaaggtcttgtgctttcgacgggcggtggttcggtgttgtctaaagataaccgcaatgtgctttcagctcgtggtattgtggtttatcttgaaactacggtggataaacagtttgagcgtactcaacgtgataaaaaacgtccgttattacaaacggaagatccatatcaaacgttagttgaattggcgaaaattcgtaatccgctttacgaagaaattgcggacattattttgcaaactgatgaacaaagtgcaaaagtagtcgcaacgcaaatcattgatatgattgataatttacagtaatcagggaagtctatatgttgcaagttaatgtggaattaaaagaacgtcgctatcctatcgcaataggggcagggttattaacggatccgatgagttatcacccgttaaaatcaggggataaggtgatgattgtgtctaatccaacggttgcttcccattatcttgcaacagtagaacaaacgctaacagctatcggttgtaaagttgattcggttttaattcccgatggcgagcaatataaaaaccttgactcactcaatcttatttttactgcattacttgaaaaaaatcacaatcgtgattcggtattaattgcgttaggtggtggtgtaattggcgatgtggctggctatgctgctgcgtcttatcaacgtggtatccgttttattcaaattccaaccaccttattagctcaagtggactcttccgttgggggaaaaacggcggtaaaccacccacttggcaaaaatatgattggagcgttttatcagccgatttcagtcattgttgatacaaataccttaaaaaccttgcctaaacgtgaagtgagtgcaggcttagcggaagtgatcaaatatggtgcaatttttgatattcaattttttgaatggcttgaacagcatattgacgatctcgttgcccttgaacagtctgcattagagtattgtattcaacgttgttgccaactgaaagccgatgtagtggctcgcgatgaaacagaaaaaggcgaccgtgctttgttaaatttaggtcacacctttgggcacgcgattgaagcatatcttggctacggtaactggttacacggggaagcggttgcagtcggtatgcttgaagcagctgccttgtcgcatattctaggcgatcttacggaacaagatgtggctcgtttagaaaaattgattgctcgtgcaaccttgccaaccatttcaccagatggaatgatgcctgaagaatatctgccttatatgtggcgagataaaaaagtactaagcggtcagttgcgtctgattttattaaaatcacttggcacagcttatgtcaccgctcaagcgaccgaaactcaagtgttagatgctatccgtcgatttactcaatcctaagttttaacaatgaaacagcgagcctttttaaaatgggcaggtgggaaatttcgcctgaccgatgaaattaatcggcacctaccccaaaaggcttgcctagtagagccttttgttggggctggctcagtttttcttaatacacattttgaacgctatattcttgctgacattaaccctgatctgattaatctctttaatgtgattaaagctgatgtggaaagctatatccagcaatcgcaagccttgtttaatgatccacaagcaaatacggcaaaattttattatgagcgacgtaaggaatttaatgcttgccaagatctgctacgtcgttcagcactgtttctttatctcaaccgttttggttttaatggtttatgtcgctataaccaaaaaaatgagttcaacgtgccatttggcgattataaaacccattatttccctgaaaaagagttacgcttttttgcggaaaaagctcagaaagcggtatttatctgtgccgattttcatcaagtctttcaatatctattagataatcctgatgattatgtggtctattgcgatccgccttatgccccgttgaagcaagaaacgaattttacccattatgctgggggcggtttttcccttgagcaacaaattgctttagcagacagagcaaaacaagctcaacaggcgaaaatccctgtcttaatttcaaatcacgataccgagtttactcggcaaatctaccgtggagcaaaaatcaaaaaactgaaagttcagcgtcacatcggtcaatccattgactctcgaattaaagtcgatgaactttttgctctgttctcttaacttccttttgtatgcagtaggaaaaaatatgaatacacaaccccaagaacgccaatcgtggtcaaatcgattggcatatattatgaccgtagcaggtgcaaccgttggttttggtgcaacgtggcgtttcccttatttagtcggtgaaaatggtggcggagcttatgtctcgctattttgtatcgcaatgatcgtgatcggtattccgatgatcttggttgaaaatgtgattggtcgccgtatgcgagtaaatgccattgatgcctttacgggaaaatcgaatggtaaagccattcaccctgcgtggaaaatcttgggttatatgggattattaggatcttttggtatccttgcttactatatggtgcttggtggttgggtattaaactatatcggcagtcttgtaacgggcggtttagatctatcatcacctgttaccgtagaaactacatctacttattttaaagagagtatttttaacagcccagttaccattttggcttatactggcttgtttgtattagtaaactacttcatcttagtcaaaggcattgttgatggcattgagcgttcagttaaatatcttatgccgatactctttatcttcttgattattatggtgatccgtaatgtcactttaccaggggcagcagaagggattaaattctatttaatgcctgatttctcaaaaattacaccgcaattgtttgtctttgtattagggcaagtcttctttgcacttagcttaggtttcggcgtattaattaccctttctagctacttagataaaaaagaaaatctagtgagaaccgcgacaatcacaggggtattaaataccgtgattgcagtcatagcaggatttatgatcttcccatcactctttagctttggcattgccccaaattcaggctcaactctcgtcttccaaagcctaccaattgtcttctctaatatgtggagcggtacgatctttgctattattttctttggattattagtggtcgcagcattgacgacctcattaaccatctatgaagtgatcatcaccgctttacaagaaaaaccaaaatgagccgtaaagcagcgattttctggacacttaccctgattttcatttttggaaatattccatctgtactaggcgataatgtctggaaagatgtcaccattatgggcaaaagtatttttgatgcctttgactatatcagcggtaacattttatttattctcaccgctcttggcagtgcaattttcgttggttttgtcttaaaagatgaagcgaaggaagaattaggggcagggaaaacattaacgaatttgtggtttaactatgttaaatatgtgataccgcttttgattttagtggtattttttagctcgctttaatttaaactgacttaacaagtgagcatttacataataaaattcacaactcaagcagtaatcaatagggttactaatctactccactatttttattttaagaggtcttactatgaaaattatcttattaggagcacctggtgcaggcaaaggtacacaagccctatttatgatgaagaaatttggtattccacaaatttcaacaggggatatgttccgagctgccattaaggaaggaacagagttaggtaaacaaatcaaagcattaatggacgagggaaaattagttccagatgaattaaccgttgccttagttaaagaccgaatttctcaaccagattgtgcaaatggtttcctgctagacggttttcctcgcactattccacaagcagatgcactaaaagaagctggtgtaaaaatcgactttgtattagagtttgatgtggcagatgaagtaatcgttgagcgtatgagtggacgtcgagttcatcagccatctggtcgcacatatcatgttgtatataatccaccgaaagtagaaggtaaagatgatataactggcgaagacctaattattcgtcaggatgataaaccagaaactgtactagaacgtttaacgatttatcataaacagactaaaccattgatagcgtactatactacggaagctgaagcaggaaatactcaatattaccgtttagatggtactcaatctgtagaatctataagcgatgaactcaataaaattttagggtaatttcctttctacatatagaatcaaaaatagttgctaagaaccaatacgatcttagcaactatttatctcaacgttttattatttaatatgtctttcttgataccccgtataaatttgtcttggacggacaattttgaggctctcttcgcacatttctttccaatttgcaatccacccgactgttctgcctaaggcaaaaataacagtaaacatggaagttggaatgcctatggcttgtaaaataatacctgagtagaaatcaacattaggataaagtttgcgttcaatgaaataaggatcgcttaaggcaatgcgttctagttccattgcaacttcaagtaatggtgttgttattcctaattctgcaaggacttcgtggcaggtttcccgcataacttttgcccttggatcgtagtttttatatactcggtgaccaaatcccattagacgaaatggatcatttttgtctttggctcttgcgataaattcaggaatacggtcaaccgtgccgatctcctgtagcattttgatacaggcttcgtttgctccgccatgagctggcccccacagtgatgcaatccctgccgcaatacaagcaaatgggtttggcccagaggaagcaacgcctcttactgttgatgttgaagcgttttgttcgtggtctgcgtgaagtgtgaagatgcgatccatagctcgttctagtacagggttaaccacataaggttcacaaggtgttgcaaacatcatgtgtaggaagttgcctgcgtaggataagtggtactgcggatacataaatgggcggccgatgttgtatttgtaacacatagctgcaagggttggcattttggctaagaggcgaatggcggttttttctcgatgtgcttcgtcatcactgtctagcatgtcattgtagaatgcggctaaagcactacttgctgcacacataaccgccattgggtgcgaatctcggcggaaaccttgaaacaagcgggtaaattgttcatttaccatgtaatgtgaacagatctcttttttgaactcagccaattcttcttctgtaggcagttcgccatttagaagaagataggcgatatcaagataggttttatttaaagcaagctcgtcaatcggatagccacggtgcaataagacaccttgttcgccgtcaatgtaggtgatactagattggcatagtgcggtagaggttagcccttgatcgtaggtaaagagttggtgcttttgtaatgcctcaacgccaattgcatcaaaacctaagttactctgataaacgggcaatggaattttacgcccatcgttaaggtgaagttctgcagttaaagtcgggtgtagtttaggcattttgtcctccctgttatcgtaaattttatgcaaaatcaaaccgctgtttgaaaaatgaggttatccgctttttgggtataacgttgaatttggtcaaaattcatgtagcggtatgtatccgttttatctgcctctaggcgttgtacataatctaaatactctttccatgtaggaatgcgtcctagtaatgcacagactgccgcaagctctgcagaagcaagatagacaaaagagcctttacccatgcgatttgggaaattgcgtgtagaggttgaaacaacggttgagccgtcggctacacgagcttgatttcccatacaaagtgaacaacctggtatttcaattcttgctccacttttgccataaatgctgtaatagccctcttcactaagtagtgttgcatccattttagttggtggagcaatccataaacgtgttgggatcatgccttgatgctggttaagcaatttacctgcggcacggaaatgacctatgttcgtcatacaagagccaataaagacttcatcgacttgttgaccttgcacttcggaaagtgttctagcatcatcagggtcatttggggcacaaagaataggctctttgatgtcatttaaatcaatttcaatgatagcggcatattcagcatcgctgtctgcttctaataattgtggggcagccagccactcttccatggctttaattctgcgttcaagggttcgtttgtcgccgtaaccctcggcaatcatatattttagtaagatgatattagactgaagatattcgatgatcggttcttgatttaatttgatggtacaagccgcagcagaacgttcggctgaggcatctgaaagttcaaaagcctgttcaactttaaggtactctaatccctcaatttctaaaatgcgacctgagaagatatttttcttacccgctttttctaccgtcaatagcccttgtttaatagcataatagggaatcgcatgtacgagatctcgtaaggtaatgcctggttgcaattcgcctttaaaacggactaaaacagactctggcatatctaatggcattacgcctgttgcagccgcaaaggcaactaagcctgaacctgcaggaaatgagatgccaatcggaaaacgtgtatgtgagtcgccacctgtacctacggtgtcgggcaatagcattcgattaagccaagagtgaataacaccatcacctggacgtagtgaaataccgcctcggttcataatgaaatcaggtaaggtatgatgtgtcacaacatctacaggtttagggtacgcggccgtgtggcaaaatgattgcatcactaaatcagctgagaaacctaaacaagcgagatctttaagctcatcacgggtcattgggcctgtggtgtcctgtgagccaacacttgtcattcgaggttcgcaatactgtcctgggcgtatgccctccacgccacaagctcgcccaaccattttttgtgcaagtgtgtagccgactgttgttttagcctgtatttgaggtttaacaaacacttcactttctggcaatcctagtgccatgcgtgctttatgtgtcaaacctcgaccaataatcaatggaatacgtccgcctgcacgaacttcatcaagaagcacattcgttttaagactaaactgggctaatacttcgtcactgccatgcttacaaattttgcactcatagggatagaggtcgattacatcgcccatatttaattggcttacatccacttcaatgggtaatgagcctgcatcttccatcgtattgaaaaaaataggagcaatcttaccgcctaataccacacctccagctcttttattaggaatgtaaggaatgtcatttcccatgagccataagaccgaatttgtagccgatttacgtgaagaacctgttcctacaacatcgccaacataaacaagtggaaaacctttttgtttaagggcttcaatctgtttcattggaccaactacaccagcttggtcaggttcaataccctcccgttcatttttaagcatagccagtgcgtgcaatggaatatctgggcgtgaccaagcatcttgtgcaggcgaaagatcatctgtattggtttctcctgtcactttaaacacggtcagtgtgagtttttcggctaattttggacgagataaaaaccaatcagcattggcccaagaggttaatacttctttagcaaagcggtttccttgcttcgctttttctgccacatcatgaaaactgtcaaatactaagagcgtatgagagagtgctttgacggcaataggagcaaggcttggatcatcaagtgcttcaacaagcggttcaatgttgtaccccccttgcattgtgcctagcaagctgacggcttgttgtggggaaatgagcggcgaaactgcttgcccttttactaaggctgctaaaaagctggctttaacataggctgcttcatcaacccctgctggtattcgattttcaaagaggtgcaagagtaatgctttatctgcatcagcaggttctttaagtaattcaataagctctgctgtttgcgctgaatttaatggcagtggcacaataccttgtgcagctcgttcaaaaacatgtgtttggtattcagttaagaaagacataatgatgatccccacttcaatatagataaaaaatgagcgatgagataatcataacagagagagtaaaaacgacaagcaataaatttaacagattttacattttgttaacaagatcacaaaattgcatgattatctctatgtgtataagtggttacatattggcgacaatatcttgggcaaattccgaagttgtacggagtgttgccccctctaatgtttccgcaaaatcaaaggtcactgtcttatttgagatggttttggatactgcgtttaccactaaatctgccgcttcagtccaacctaaatgtcgtagcatcatttcgccactgagtatgatcgagcctggatttgctttgttttgacctgcgattttaggcgctgtaccatgcgttgcttcaaaaatagccgcctcttcccctatgtttgcaccaggtgcaataccaataccgccaacctgtgccgcaagtgcatcggatatgtagtcaccattaagattaagcgttgcaatcacatcgtaatcacttggatgtaataaaatttcttgtaaaaaagcatcagcaatgcaatctttgatgatgatctctcgtcctgtatttggattttttaaacgatgccaagagccattatctattggctctgcaccaaagtctttggcaacttggtatccccactctttaaatgccccctcggtaaatttcatgatgttgcctttatgcactaaagtgagtgatttacgatcattatcaatcgcgtactgtaatgcagcccgcactaaacgctgagtcccttcttttgaaacgggcttaataccaatgccacattcttccgtaaagcgaatttttttcacgcccatttcctgccgtaaaaaagcgattactttttcagcttcataggaacctgccgcccattctaccccagcataaatatcctctgaattttcacgaaagatcaccatatccactaattctggatatttcacaggacttggcgtaccttggtagtaacggattggacgcaagcaattatagagatctaactcttgacgcattgctacgtttaaagaacgaatccccttgccgacaggggtcattaatggacctttgatcgcaatatgatactgtttaattgatgctaatgtttcttcgggtagccatgtgttttcaccgtaaagtcggttagctttttcccctgcataaatctctaaccagtcaatttttcgttgaccttgataggctttttctaccgcagcatcaattacaaaacgcatggctggtgtgacatcaacgccaattccgtctccctcaataaaaggaataattgggtaatttggaacagacaatgaaccatcatgatttagttgaatagcttgcccttttggtgtagtgagttgagatagcattatttcccccttaaatgcgacctgataccgcttaattgagtttgaaaataaaaacagcagatgttgtattttttacaagcaacgggataataccatcagataacaaatttaacaaaaaatttacatttaaaaattttcatcattatctgcaagttacataaattaaattcatgaaataatgaaaataattttattgacatcatatcgctggcattttaaagttttagccatctaaacgtctaaaaaagacggcagtatgcaaactaaacattatacaaataacaacaatagaagctcgatagaggtgttgaatgagttatgcaaaagagattgatcttttaaatcaaagtgttgccgacttaaatggcaaaattaatgtgtcttttgaattttttccgcctaaaaatgaaaagatggaaacgttgctatgggactctattcaccgtttgaaagtgcttaaaccgaagtttgtttctgtgacttatggtgcaaactctggggaacgtaatcgcacgcactctatcgtgaaaaccattcaacaagaaacagggattgtcgctgctccacatttaacaggtattgatgcaacccctgacgaacttcgtgctattgcaaaagattattgggacagtggcattcgtcacattgtggctttgcgtggcgatgagccagctggctatgcgaagaaacctttttatgcgtcggatttagtaaaactgttaaaagaggttgccgattttgagatttctgttgccgcttaccctgaggttcaccctgaagcaaaatcagcccaatctgatttgctctatttgaaacagaaaattgacgcaggtgcaagccgtgctattactcagtttttctttgatattgatagctatcttcgcttccgtgatcgttgtgcaacggtggggattgatgttgaaatcgtgcctggcattttgcctgtgtcgaactttaaacagctagaaaaaatggcaaaaatcactaatgtgaaaatccctagctggatggcaaaaatgtatcaaggtttggacgacgatcaaactacccgtaaccttgtaggggcaagtattgcaatggatatggtgaaaatcctctctaaagagggagtaaaagatttccacttttataccttaaaccgttcagaattaagttatgctatttgtcatactttaggggtaagacctgaataagctattcactatagaccaacccgatcttcgcagatcgggttttctctatttggatgcttatctttctgtattcaaaaacgtaactttcttgtaaaatccaaccgcttatcacgacattttatagaggatttataatgacattaaaaattggcgttgtcggtgctggtggcagaatgggtcgtcagttgatccaagccgtaaataacacagagggcgtagaattaggttcagcatttgaacgtaaaggatcatcattagtcggggctgatgctggcgagttggctggtattgggcatttaggcgtgactgtcacggacgatttagcttcacagctcaatcattttgatctattaattgattttactcgccctgaagggacgttggaacacatcgctttttgtgtcgcacataataaaaaaatggtgatcggcacaactggttttgatgatgcgggcaaacaggcgattaaatctgcatcagaggaaatcagtatcgtctttgcttcaaattacagcgttggggtgaacttagtatttaaactgttagaaaaagcggcaaaagtgatgggcgattattacgatattgaggtgattgaagctcaccaccgccataaagttgatgcgccatctggcacggcactttcaatgggtgagcatattgccaaaaccttaggtcgtgatttaaaaacgcacggcgtatttgcgcgtgaagggatcacaggggaacgtaagcgtgatgaaatcggttttgcgacgatccgtgcaggtgatgtagtcggtgaacacagtgtttggtttgctgatgaaggcgaacgtgttgaaattgcccataaagcttcaagccgaatgacttttgctaacggtgctgtgcgtgcagcaaaatggcttcaaaccaaacaaaacggtctttttgatatgaccgatgtgttggatttaaacaatttataataaagaaaagcggtcagatttaatcaaaattttgcaaaaggatagatatgaaatataacaacattgaaagtactttagtccaactgggtaatcgtactgatgagcgtactggtgcggtggcgaccccgattttcctttcgactgcctatggacatatggggatcggcgagtccacaggctttgactatactcgtaccaaaaacccaactcgtagtgtacttgagcaaggcattgcggacttagagggtggcgatgcaggttttgcattagcgtcaggtatggcggcaattcaattaattatgtcgctctttactgcccctgacgagtggattatctctagcgatgtttatggcggaacttaccgcttgttagattttagctacaaaaataacaataccgtgaagcctgtttatgtgaacacggcagatcttgatgctattgagaaagcgattaatccaaatactaaagcgatttttgttgaaacaccgtctaatccattgatggaagagtgtgatgtcgcagcgattgcgaaaattgctaaaaagcacaatttactgctgattgtcgataatactttcttaacaccagtattattccgcccgattgaacttggggcagacattgttattcacagtgcaaccaaatatttggcaggacataatgatgtgttagctggcttagtggtagcaaaagggcaagcgttatgtgaccgcttgttctatttgcaaaatggtgctggggcagtgctttcaccgtttgacgcttatatgattattcgtggcttaaaaacccttgcgttgcgtgttgagcgtcaccaacaaaatgcgaccgaactcgctaaattcttagcggaacaaccgcaagtgcaagatgtgctttattctggtaaaagcggtatgttatctttccgcttgaaagatgaaaactgggttaatccattcttaaaagcgatcaagatgattacctttgcggaaagtttaggcggtacagaaagttttattacttaccctgcaacccaaacccatatggatattcctgaagcagaacgtatcgctcgtggtgtgtgtaataagctcttgcgtttttcggtggggcttgaacacgttgaggatattaaagcagacttgctacaagcctttgctcagttgaagtaaattggtgtaatagacaaatttgttgctaaaaagtggcttaaagccttatagtacaaggctttaagccacttttttttgaaatataaacaaaaactacccattttgccaaagtccgaaaataaagaaacatggtatacaaaataatactcaaccttacttttgtaatgaatgtcataaaacgtttatcttaaaaaatgaattttattagcgattacgtccttagtttataaaacaccaaacgtttttaaaagaacgaagtgataaagccaataaaaaagaccatttcccttataaacgtcgtaatgcaagaagtgcttataccaggcttaaagcgttatatggattttatttttacctatgagaaatattctgaattaaatatagaaaatacaataaatcgcttagaggaattatttagcgagcttaagcaaaaattaaataatcataactgattaacaaaaaggcgtaatatgttgtttatacaagattttttaaataaaaagagttgctaagaataattaaaaatacccattagcaagtattttatctattatccctatcagttagacaatctgtttttttgtaatgcgcgatgttttacttgatgtacaatatttgtaatcaccccagcgatattgacgtcactccactctttaatacgtaaattaggttctgaggtgtctaaagaaaataaaattttctctccattaatctcactgaaaaattggtagaacttatactcttgatttttctctaataccaaaagatcgttaatttcagcagattgattattctctacaattaacaaatcatctaattcgatcccccatgcaattaaattagggtttttcacatgaaccagaaaggtttcagaaggacgacgaacataaagagaatagagatccagtttgattgggtgctttatattagaatctcgataaaggggtaaaggctgatgggattgtgccaatgttagtgatctaagatacgccataaaaatcctctaaaataaatctgtgtgtttatacagttattttactgtttaaacacacagtgtcaataggaattttgcgttttagtgtaaatttttacaggtaaatcatcaatcaatattttttagctgttcttcagataatgtttcttgctcactattttctgttttaccatcttttactttaaactctaaattttgaaaataggcttctcggaaagtaatgtaaggatcttgagattgcttcaataacgcttcttgtcctataagctgtgcacgggaatctactccttgtacgacatattttgtgatactccaaggtgtagcgagtaaagataaaactggataactagtatctactaatcgacctaaatcttgacgaggcgttgcaggtccatacattggtaacatcacataaggtcctgtaggcacattatacgcgcctagagtatccccaaattctctacgtttatcaattttaagatcattggtcatactcgcgaagtcaattaacccgcctaatccaaagatagagttaaaccaaaagcgagtaaagtgaaccattgctttttgtccttccccttcaattaatcggtttacaaagctggcaggttcatcaaggttatttgccacattgactaaacctgttttaattgggctaggtacataatctcgccaaccttttgccacaggttcaagaatataagggtctagatattcgtaattgactttccacatggcacggttaaatccttccaacggatctgaacgggtgccagtttcaggatcaatagaagcagtacaagcggttagaaaagcggtattgagaactaaaaatagaagtttaatttttttcatatgactactttaaaaaagggttgtgttgtttttcacgtcctactgtggtatgagatccgtgtccaggaataatgataaaatcatcttctaaatcaaatagttgtgtttttattgtataaatgagctgctcaaaattaccttgatataaatcggttcttccaatactatctttgaaaagcacatcgccactaaaggcaattttattctcaaaatcaaaaaagccgatatgacctggtgaatggcctggtaaatggcgaatatggaatgttaaagccccaatttgaattttatcacctgcatttaaccagtgatctggtagaaaagcgggcgatgcaggaagcccgtagctctgacaaatattaggaagttgttcaaaaagaggttgatcgttttgatgagaaccaaagacatcaacattaaaatgttttctcagttgatcgacagccataatatgatcaagatgaccgtgagtaatcaacaatttctgcacatttaattgctgttcttccacaaaccgaattattttgtctgcatcatcaccagcgtcaataataaccgcattcttttcgttatcccaaacgacagaacaattttgttggaaaacacttacagggataatttgcaaattaaacataaaatcaaaccgcttatgaaccacgccaagtacgaacagggccagtgtcgacgtggacaaaattactgtgaggataataaccaacccccccgttattcaggctttctgctgccgcttttatgcgggcaagaggaacaccttcaatacggaaatcaatggctttacctaaaatatggtagctattgctagcaacgcctcgactacgacggcgtaatctagcatttgtttgagcagaacgatatccgcttacaataagaatttcagatttacgaagacccaagcgagcttgaatttgagttaattttacgaatagttttgggtcaattcgcttaattctgttgatatgcacatcgcgcataatatgatttaatctgttaagatcctttgcagcaaatccgttagtgtgataattagcagataaggtctcgcctgtacttaagcgttttaaacgtagaataagaggttttggagttgacgttaccgcatgaactaaattaggtaacaaggttgcacccaaaactattccgcctaatgcaagccatcttcggcgttgtaaatttgtttgttccattttatcctcgcatttgggttatttaccgacaatctctcctttaatctcttgaaggtaaatatattcaacctaacgtcgacattttatcaaaaaggaagttctaaaaaatagcctatcgttttcggaaattttttattttgtggactagatcacactttttactttttcccaatctaagttgattttaggtaatgatttatcaaattgataaatatcaggtaaggtgtatattttaccgccttcaatccaggatgttacataatataaataaacaggattatctgaacgaataggtgcagaagttgtttttttgcttgcaagaacgtcctgttttctctgcgctgaccacccagcttctgctaataataacgtagctagttcatctgctttagctacacgaacacagccagagcttaacgcacgattttttttactaaataaccctctatttggtgtatcgtgcaaatagattgcatcggaacttggcatattaaatttataacgccctaaagcactatcatctcccgctttttgacggatatgatacgggaaattattttttccttcataagctgcccagttgatactatgagcactgaatttattccctttcccatctaaaatttcatagcctaatttatcagcaaggattggatctttacgaagttttggtactaaatctttattcttaattgttgatggaacattccaaggcggattgacgacaacgttgctcagtttgctgtacatgacaggtgttttgcgatcatttcttcccacgattactttagactgtaaaacaagtttgccctctctgaaataatagagctgatagcttgggatattgacaaaaattccattattaaaacttggaataagacgtaaacgctgcgcattaagtgctaattgagtaaatgaaggcgtgtttacactacctttattctcttttgtagattttgctgatttattaccaccctgattgagagcatcattagatgatatttcaaataatttttgtacggtttcttggtaaatatggtttttaggtattagatccgtgacaaactgagcgtagcgatcttgcttaatcgcttccaaccaagtagcaatacgatattctgttggtgttttaattgaataacttcctaaatgatataaccattgatttgcaaattgatcgacattttctgtgtaatagagatagtctaagaaactatctgtgagtagaatatcgcaagcaaatccctcattcatatttagaatttgttgtaacgcattagccgatttaggcgaaacgccgcttacagcgaatactgcatattcttttaaaaactgtttttctgccactttatctttccacaaaggggcaaactcattattgagatagacttttgctgtcgtattggataataataaatgatagcctaatgtttcttgttgaatacgttgttcggcatgaattaatttttcggcttcaatgcgttttctttcagccaattgaaattgatattctgcatcttgtgtcagttcagcaatacggactaattgcgctttaaaacttaactgaggcaaaatttgttcatcaggaacaggcgttgcagcattatgttgagaactaacattcaacgcacttccattttcagcaaccacagcactagaaaacaatattactgacaaaaaagttaaacttttcattcaatttaatccattaggaaaatgagtaataaatcagaccgcttaaacagcggcctgataaacttccacattataaacgtatttattattttttatcaaattgtaaccaatcaaccatcatctgctccgtttcttttaagaagaaatcaggagcttcatagtcttttggtaactgttcaagatctttgatctgttttttaccttcacgtttaaagcgggcatttaaatctttcaaacgacgagcttcatcagatttactctcttcttgacgagaagccaaattaagtgaggtaaatttacgatcatctctttccttattaattgcgatagtttcatttaaagcaataaattcaggatttttagcaatacgtttttcgtgattttcagtgagttgtgcaactacatctctagcttttgcgacttctgaataagttgctgcaggaattttatcccaaggcaaagcattatcttcaaatccttcccctgttttttctgcattgataatttcagggaaacgaatatctgcttcaacccctttaatttgggtgcttccaccattaattcgatagaatttttggattgtatattggataaaacctaacggctcttgatccaaatcataaaccatatttaaagaacggttttgttgaacagtacctttaccaaaactttgctgcccgataataatcgcacgattgtaatcttgcattgcagccgcaaaaatttcagaagccgaagcactatgacggttaatcatcactaaaatgttgccatcatataatgttgtactatcggtatcttcgtgaacacgaatacgattaaaagcatctctaacctgaacaacaggaccatctttaataaataatcccgttaattccactacctcaggcaaagaaccgccaccattttcacgcaggtcaataatcaacccatctgcttttttggttttcatctgttcgagaagtttacgcacatctgcagtcaaaccaatatagaaacttggaattttgatcacagcaatattttttccgtctactttatcaacagttaatttcgccgcactgtcttcaagacgaattttatcccgaactaaactaataatcttggttttgccgcctttagcaggttcaatttcaagataaaccgtcgaaccttttttacctttgatattatcgacaacatcatctaaacgccagccaatcacatcttcgattttatcttttgattgccccacaccaacaattttgtcacctgctgcaatttttttactacgcgctgctggcgcaccaggcactaaagatttaatgatcgtaatatcatcttccattgaaagcgtcgcaccaatgccttctaaagacaagttcatactctcttggaaacgtttagctgcacgaggtgaaagataacttgtatgcggatcaatttctcttgcaaaagcgttgagataagtttgcagaatatcatcggctttattttgtgttaaacgacgaattgccaagttataacgtttagtcagtgttttcttgatttcaggccatttcttatctttcaaataaagattaataatatcgttttttactcgttgcaaccaaagctcatcagcttctgtggtagttttcgggaacggtgctttttcacgatcattttcaatttgatcctgcccttttaaatcaggctctttatctaacaaagacaaagcatatttataacgttcataacgacgttttgtcattaactcatacatttcaaaggcaatatctagtttgccttcatagagttcttcatctaacttggttgcatacttagcacgcaattcatcaatatcagactgtaaaaaggtattgtgagaaccatcaagccaatcaatataacgattaaagattttctcagaaaaagcatcatctagttgaaacttatgataatgcgattgtgttaaacgagctgtaacacgtttagttgaaatactatgttgttctgttggttttggaatgattaattcactttcttttatttgaggttctgcagcaaaactatttatgctacaaacgcccaaacataacccaagtaatgtggtgaatttattatatttcatatcaatcctataaatgcgactatttcttgcctttggcaaatttgctttctaatgcggacaaactttctaaagatgcttttggcatttcttgttttttcgtttcagcccgttttttggcatgtgcttcacgtgctttttgtttaaagaaagttttacgctcttccttgcgtttctcttttaattgtagagctttacgttctgcataagctgcttttgcttcggctaaagattgcgctgcatgttctgcttgtgcagcttcaacaacacccgcttcttctccttgaagaccgacacgtacagcaccttctttacatgcgtgtaagtaacgccagctcattgtataaacgcgtaatgcttgacgaagccccgttttactgattttttcatcattactcagcgcttcaactaaatcttggaaaagtccaatttttagaggtttagcttcgccttctaaactaaagcaaagcggaaatttttcagccaaataagcaatgatttcttttgtagataaagcggtttttaggttttgaatggtattaagttgttgttcagacataaaatgttccaatctaaaaaatgaatgttaggtaagcgaataaaaatgctacctactatattttatttagttacagtagtccatagactttccaataagttccttattctttagcagggcaaccgcatatgttgtccatttttcaacctacacgccgagcaacagctcatctcgaaattcatctgaccaaccagcagcggtcaatttccctttcatactctgctttttcgggtgtaatcgtgccaagttcaacgctaatcgacgcaagattgccagattttccgcaccccattcatcggtcacagcacattcgtcttctttatagaccacatctagcacccaatgggctttgttttccacttcccaatgccctcgcacgcacttcgccaatatttgaatatcaacatccaaactactgatataaaagactttttcttgcgattctttgccattatctgaccgcttgcgacacacctccaacaccgattttatccccttccattcctccgctttgctcagccaatcactcactttcagcttacggtagtaacgctcatcaattcgacgacgttccgcatttacctcctcaaacgtctcaagcatttcggggcaatctcggctgattttgtgaaaatacgcctccacttccgactgaaattgacggtgatttttcttcaacggcatcacataatcccctttcttttcgatgattttctcggcaattttcttctgtgtattcatcgcatccaccgttacaacggcattttttaagcaaaaactatcgataatttccatcaccgcctgctgctcattttgcttacccgaggattttttctgcgataaaatcaaaccacgagactggctccacacagtcacactgtgcaaagcactttgggtttccggattgaaactatgacgaagtgtcttgccatcaatcgcaatcacttcacgtccttgttgtgtgcgtatctcattgataaaattaagaaaaacctcattaaacgcttgaggctcaatgcgttttattacacgagcgatagtatcatcgacaggaataccacactcaaaaggacgatattttcgcaaccaatccaaatgtaattcgccaaaaagtttgatttcagtccagctgtttgcccccgacatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgtattctttagtaaaaattttattttttaaaataatatttgccttatacagtgataaatgttgtaatgttgcccgttgaaattttcaaccatttttaggggctgacgtagattagccctaaatttcacaccattttcgcaatgtttttaactgctcttttggtgttccaaagtgaaaccgaaattcacattctttcaagaataaagggaaactttttcggtcaattccattatattttcggagtatccgcttggcttgactccaaaaattttcaatgccgttgatgtgattttgtttcactgtaaacagctccgaatggttaattcgttcgtggtgaaattcgcttacatcaagggcatcataactatgataagtatctgtataaacccagctgtcgggcttgattttccttgacataacaggcattagcgttgttatcttcgtatcattgactaccacagtaaatacttttccttgccgtttcaatatcccaaaaacagccactttccctgccgctccacgacctcgttttcctttacgatgtccaccaaaatagctttcatccaactcaatttgtccgtcaaatacttcatccacttcaagtgctaaatgataactgataacctcgcggattttgcgataaaacaggattgctgaattgggctgaataccgagtaaatctgcggctgatcgagcagttacttctaacacaaaaaattcaagtagctttttctgtatagatttctttaatttacaatgagttatcttcatttttgtaggttagcatgctagctaatctacgtcagcctctaaatctttcatcaaaccacgtctaccatcacaggtaatcgattgaattatatagccttttttctcttaacctattcagggcaagtttgtagtaaatatctttttcggttcgcacaaaataatgggaaatgacattatttgaaagcgtatccattaacactaatacgccaaaataacgtccgaaaaacgttgtatccataatgatattcaggtatcgatttgaaggcagttttaaagccgttttaggtgctttatcgatatatctttgaatcgttctgactgaacaatgatatttaacggcgagttgttgataggtttgttttccggatgtgtaatcagtccaaatcttaattggatctaatttagtttttaagataaaggttttatgacattcattacaaaaataacgttgagtcttattttgtattccatgtttctttattttcagactttggcaaaatgggcagttttttgttcatatttcaaaaagagggcttaaggccttgtactatagggctttaagccactttttagcaactatttgtctattacacctatttaattttcgcttaagttcactaaatgatccctctaaacgatttgccatcttttctatatttaattcagaatgttttgtctgttacatgaatttcctactccgccaacccctgatcccactctaatgcttcttcaggtaatttacgttgtaataaaaatctgcggttagcttctgcctgaggttgaacaaccttacttgatgggattgagaaactaattccgccgttaaataattgagacattgtgcctgagttgatactgacaccattgaggctaatatccattgtatagcctgacgaagcccagaactcgctatttttacggacaaggtgtttatattggttggctatgcgtaaatggatcagcactcggtcgccgagttcgcttaaactgagctgttgtaccatacccacttgcattcctcgatacattacaggggcttgaggggtgatgccatttgcgtctgtggtttccacaatgattgggaagccgttgccgtattgtgtatctgcggtgtccgttgcccctaatttgaactgtgtttttcgtttgccatttccggcttctacgctgatgtagttttgaataacggcatcaagatttttgaagcctgttgtgtcaatttcaggggaaacggcattaaatttgctacctgctttggcaacgatggcataatattgtccttcgatgtaagcggtggctttaacctgtttttttgcattgtctagctgtagcgtttcaacattgccgatggttaatcccatatacttaatcggcattcctttgcttaatttagaagcatcttgagcaatcaaggtgatataagtattaccagaagtcgctttcgtataactgctgtataaggttttgttacctttagttccttgattatcaaagctaatcgcccctttgagtgttcgcattagtgaacccattttgagattaacaccgttggtagacacgtttacatctaccgcaggctcaacccaaaatcgactagtttccgtcagcagatggcgatatttaggttcaataaatagatcaacttcaaacttcgttttttgtgggcgaatattaagtacttcacctatcgggaagttgcgataaagcacttgtgagcctttatcaatgccggataattctgtagcagacaaactcagcgttgcctttttctcaccgcttacaataccagcttcagcactctcaagatctttgtataacggatattgttttttcgcttccccttgagctttatctgagagaatacgaataccgccagcaagccattcagatggagaagcagattgtactcttagaccatctaagccaacagcaatatctaagtgtgaaatcgccacaaatttgctgttccctgcgacaagggtacgataaggcggatagatgatgccttgaaattctacgccgttaagcgataactggcgtttcacaatttcaccgatttgtatatcgttatagtaaatgccttgtccttcgcttacgccataagattgcggcgatgaaagggtaattgctaaaacgttaggacgagtgagcaaataatcagcttctttttgtacattaaacgtcagtttaggctcgccatcacccttttcaatttcaaagtaagtccctctcaatagctcacccactttactcaattgttctttattgagtgcaaatttaggttctttcaggagaatttgactgcctgagcgtaataaatccgtatgtgcagggtcgatcaataatttaccttgaatagtcgctttggttggtttggtttcaaagtaatcttgttcggtttcattcagttcgaggtgcgaaagtacgccaacttgcaggttttggaaatataccggcgtttcatttacttttaaattcggcatcattggcaaggtgatattgacttccgtccctcgttgagccaattttaagttatcgaaaagttgaaaacgttcgccctgtttggcatttgttgccatctcaggcgagtcaaaagcaacagccccttgcaccattgaagcaaggctatctacattgagatttacgccagtaagattggcattaaattgaataccgctaatgttccaaaagcgactttcttttttgacgagattggcgtattttttatcaataactacgtcaatttcgacattcttttgatctggagtaaagcggtaatcggcaatgcttcccactggcacttttcgataatacacgcttgcccccacagtcattgagcctaaatctgaggcaactaatttcaccaataaatcgccatcagcaacggtcactgcaggtggttcatcttcagccacaaattcatcttcactagaggcatcttcatcatcattcggcaataaagtgatgtagttacctgaaacaagtgcatctaaccccgacaccccagctaaagaggcactcggtttgactagccagaactttgttccttcttttaataccgatttcgcttcgggattaacttccgcctccacctcaacctcttttaactcattgataaaatagactttttttacttgaccaatttgcaagccttgataacgaatagcggtttttcctgcagtaatcccatcgcctttactaaaacgaatggtaattttctgtccttgctcttgaagaatttggaaaaaaagcaaacaaccaatcacaaaagcgacaattggcaataaccaaaatggcgaaattttacgaggctgtctaattttagcaggaatactgtttggcatattttcagacatcattttatcacttttaaatacaagcaagcggcgagattttgcaaaaggtttgcgaaatctcaccgctcttgtgtttattaactcattgaaaaagaagaattattttttgtctttctcatcacatttttgaatattgctacatttaccatacaaatataagctatggtttgcaagctcaattccgtgttgttggctgatttcacgctgacggcgttcaatttcagagtctttaaattcaaacactttaccacaatccatacagataatatggtcgtgctggtggttcatatttaattcatagacggctttattcgcatcaaaattatggcgagttaaaatgccaacttcttcaaattgatttaatacacgataaactgttgctaatccaatttcagactgacgttctagcaataatttataaatgtcctcagcagaaaaatgctgcatactatcacgggtgatttgcattaactcaaggattgttaaacgtggcccagtaacttttaaacctacttttttcaacaatttcacattttcttcagacatatatcctccaatagatatattaagctaattccgctaaatacatttcatcaaaaatttgtttacaccaacggtttacacgttcttcggtgagttctggctggcgatcttcatcaatacataaaccaacaaaggtttcatcatcaattaatgcttgtgaagcctcgaaagtataaccttccgtaggccagtgaccgacaattgtaccgccattaggttcaataacatcacgcacagttcccattgcatcacagaaatattctgcatagtcttcttggtcgccacaaccaaagatacccacgatttttcctgtaaaatcaatttcttttaatgtcggcataaaatcgtcccaatctgcttgagattcaccgtaataccacgttggaataccaattaataagaaatcgtaggcttcaatatcttccttcgtgctttttgcaatatcacgaatatccactagattttcacctagttgtttttgaatcattttagaaatgttttctgtgtttccagtatcactaccgtaaaataaaccgacaactgccatttgaaatacctatttacttaattcaatggaatctccattgagataatcgtttaaaatgagttcaattaactgccctctagacagcccttttaccgcagcttcttgttccaatgccgctaccaaatccgaatgcaatttaagctcaatccgtcttaatcctgacgaacgatctcgcctgagttgattacgtttattaattctaacttgttgctctccgcttagaggatttgtgcgaggtcgcccaacctttggcatattttcaaacagatcaagcgtaatacaatccgaatcttgctttgccattactacaatttttgggctgagtgcttcttactcagatgcgaatgagaagctaattatcaaagtgcgaactatagcacaatatagaattattggaaacgccctatcaaaatattcattataaattgagattacctaaaacataattagctattattctgctgccatataactaaataaaaaatgtaaactaatttatttagtcattacctaacctatatcggtaataagccacaaccataattaccaatcccccgataatcattggtaatgaaagcaactgccctcgtgtgattaaatccgctgccgtatttacatttggatcgaactctcggaagtattcaacgataaaacggaacaccccgtagccaactaagaacaagcctgccaccgagcctgtcggtcgaggcttacggatatagccattgaggataaagaacagcactaagccttctaaaaccgcttcgtaaagttgagaggggtgacgaggcaaataaccgccacttggaaacattatcgcccaaggcacatctgtcacacgtccccaaagttcatcattaataaagttaccaatacgtcctaatcctaaaccaaaaggaataagcggtgcgataaagtcagcggtttgccaaaagttgcgattttgacggcgagaggtccaaagcattgcgacaatcacaccaagtaaaccgccgtggaacgacattcccccttcccaaatacgaaataaatagagaggatcttgtaggaaacggtcaaagctataaaagaacacatcaccaattcttccccctagaacaacgccccagaagccattaaacagcagttgatcgacctgttcgacactccataccccattagaatttttcgcacgtttggtaccaagccaataggcaaagccaaaaccaagcaggtacataatgccgtaccagtgtaaagaaaccggacctaactgcaacgcaacgggatcgatattaggaaaagttaaaaactgttcagacataaatttcctttattttaaaaacatattcacggcaacacacatcaagaaaacggcaaaagcacgttttaaaatcggcacaggtaatttgttcgctgccgttgcccctaattttgaggtaaaaatagaggtcagcgtaatccccaccaacgcaggtaaatacacataaccgaccgcatattgtggcaaattaggattatcccaaccactaatcacaaagctaatcgctccagctaatcctaataaaccaccacaaaaagaagaagtgccaatcgcttttttcagctcaatccctctgctatttaaaaatggcacaataaaagcaccgcctgcaatgccagcaaaactggataacaccccaattacccctccagcaatcaacgtagattgagtagtcagaggcttaggctctgcttgctttggcttgagcgataaaaacatcttcagcgaaagatacaggatcatcaccgcaaagatttttgtcattacactttttggcagatcactcacaatcaagcctgaaataaacaccgccaccatcaacgcaggtacaaaaaacttcacaactgaccattgcacattaccaagtttatgatggcgttgtgctgccgaaaatgtggttagcacaatcgttgaaaaagatgtacccaatgcaatcgacatcaacaaatcatctggcacaccaatttgaggcaacaaatacacaagggttggaacaataatcataccgccaccgataccaaacaaccctgctaaaaaaccagcaactgagcctaaaatcaagcaacagacaaacatttccaccatcattttttccccttaaacacccgatatggtttacgaagctcacgttttggctgagtacgaaactcttttctctcgtgggtaaactctttgttatctcgatttttctcgctttcgacttttttctgctcacccatcaacacctgagcaaactctttcatcaccttgcggtacacatcacgtttaaacgacaccacctgtcgcacaggataccaaaagctcacccaccgccagccgtcaaactctggcgttttactggttttaagattaatagccccctcgtctgccactaactgcaacagaaaccaacgctgtttttgaccaatacatacaggttgagtttgctcattacgaactaaccgttttggtaatttatatctcagccaatacttcgatgcccaaagcaatcgcacatcttttttcgctaagccgacttcttcataaagctcacggtacattgcttgttcaatgttttccccctcattaattcccccttgaggaaattgccaagagttttgaccaaaccgcttcgcccacagaacttgcccttgcttattacagataacgataccaacattcgggcggtaaccatcgaaatcgatcaatttagaccgccttatttaatcaatttgaaaatggtgtgattgtttcatatttcggctatttgaacaactagcaaggcaaaaacaagcggtgagatagccaaattttttcgcaaccgtggataactctgtggataacttgaaaatttgttgataacttttttgggataagttatctaaccgcttgatcttaattcagatcttacttcctgccatcgatcattttcgatcccttttcactgtataagcacacatttaatcgctcattttattttctttctaggataacttaaccacttttcagactaaattgccattctattcacatttgatgtgcttttatccccattccctgtggataaaattgtgatagatcgggataatgatcgtgtataacctaaaatcagcccagatattttgcttttttcctttaaaaaacaatatgttatttcattcttcttatcgaaaaaaacaagtgctcatttattaaacataatataaacattaacaactatcaaaatagtgaatttgtgggaaaatcatgtttaatgttagaatccagcccgtttttctaattgttctacaaaattttcgtttaaatttagcttctcggctaagtgggataaaaatacgatctcttttctagagagctcttgacagaccaagcgtgcagcaaggtaaacttgtgccgctaaagcggtgtcgtttccgacagtttttgcaatttcattcacggatactggctcgtgcatttcatgcagtaaccattgttgtaattcagggtcattaccgccctcttttaagattaaagctttttcgttctcatccagctcaccgtctgctaatgcagctgcaagcattgtacgtaaaataattgctcccttctcttccgaactatccgcttcaaaagctgtttggcttagttctgtcgtttggcttgttgcctggttcttttgataatcttgataggctttgtaagccaatccaccaagtgcggctaaagagccgagcttagtcaaattagctccgccgtttctgcctaacaccattgataaaataccgaccaatgctgccccaccaccaactttggtaatagtatctacgttgcccgatttgatctcaccagcagtatttttggcagaacccaatacagagcttaatacgttacctaagtccgatttactttgattagctgtgttgccgacagattttaaaacgccgtttaaaatgctattaaaattcatattgctttccttttggttaataaaaaatagttaagagtagacattatgttatcaaaataattcaatttttttctgcaataaatttctttgccaacgccgacagtgcatcggtcacatagactaacagcaaataacagagcagataaagggtaatttcagagtaatggaaaaaactcatcgccagtttaaactgcatacctaaaccacttgccccaacaaaaccgacaatcagcgttgcccgaataatgttttccatacgataaagaatgtaattgagaaaagtacgcatcacagcaggatagatcccgtaaaacaaaatttggttttgtgaagccccattttgcattaaatggcgtatcggtttttcatccatatcttcaaccacttcgccgcacagtttgcctaatacaccgaaattgtgaatggctaatgctaatgcacctggaatgatccctggtttgaagataaagactaaaatcatcgcccacatcaattccggtacggatcgactaaacagaaatagcccccgactgatataataagcgacacgatgataccagtatgttctgtggcgaaagtgtccctgtgccacgttgcgagcggacggcagaaccaaaaggaacatcgccatgcctgcaatgcctgttgccagaatactcatcacaaaggtttcccacgagagccatagggctttttgccacatttcagggtcaagataggcaggtagctcttcacccacaccagccattccaactaaaaattccgtaagataatcccaattttccgctcgaaacagttcactaagtgcagtgggttgatctttaagaatatagccccacgacagcccgataagtcctaatactatccaaaaagaatagcggataaaatagcggtcgatatgttttctcattttactcggctcctgacagcatagctccagcggtcaaccaaaacgattaacccaacaagaaagatcaagaatgtccaaacctgatcgtatttcagatcttgtagggaaagctgaatttgcataccgatccctcctaacccaacaaaagaaagtaccgatgaagagcggatcgcacattcaaggcgatacatggtatagctcaacatcgtcggcaaggcttggggcaaatagccataaatcagacattgtaacggcgttgcccctgcttcttttagtgcaaaaatcggcttagaaggcaccgcttgtaacgtatctgcatagattttgcctaagtagccagaataaggaatagcaagggcaaacactgcacctatcggatttaacccgacagccgcaacaaagaaccatgcccaaatcaattcgtgaatagcacgtagaaaacccaatatcgctcgagctgccccctgcaaaatgagtgaacgaaacagcacaccggatgcaaaggtgcttaagcaaaatccgccaagcatagacaaagagagtgtaatcaaggcataagcaaaagtgagccaagtggattgcaaggcgagtttcagtaaatcagtagaaaagtcaggggacaataaactggaaaatagtcgattaagcgttgcccaaccaccagaatgcatcaaccctttgtcgttatccacagcaaataggctcaacaaaaatgcaagcaacaacatgcccgtcagcaaatttcgccgttcatttagtccaagcggtcggttatgtttcattttttaccaatccgtataagacattaagttgctcttgagtgacttgttctgtttgcaaatcaaacacaatttttccctgtttaatgccgatcatacgatcaaaataggctttggcatattccaccgaatgcatactggcaatcaatgttttcccctgctctctcaccagcccagtcaataatgccaagacattttgtgcattaacaggatcgagtgcggacactggttcatcggctaaaatcaatttagggttttgaactaacagacgagctattgcaacacgctgctgctcaccgcccgacagttcagctgtcggctgatcgattttatccaatagcccgacggcagcaagtgcttgctctgcaatctgtttttcttgcggtttagccaaagagaacagagatcgccaaaagccccactggttcagcctgccagccaagacattgtggataacttccagttgtttgactaaatcatactgttgatgaagcataccgacttgttgggcaaactgtttattatcttgataatcttgaatgttgcgattttccaaccagatctcaccgcttgttaaaggcacggcacgcataatgctattcattaatgtcgatttccccgatccactcggcccgactaacgccacgatttcacctgagcgaatggttaaacagatgtcgtctaaaacggcttgcttgccgaaatgtttggtggtgtggtggaatgataagagagattgcataatggaattattgtctatattgcttacaggtcaatattgtagggtgggtcttgacccaccacatgaatgcgattttaaatggtgggtcaagacccaccctacaaaataacattatttaatcaacttcaactctttcgctactttctcaatatcttgatagttgctgttttgcgttgggataaacttctcggcagagagtaaattcatcacctgcgagcttgacgcatcggcttttaataatgccgctttgactttctctttggtaccgtcaccaaattttttatcaacaagattaatggtccagttgtaatcatagtaatccggtgtagtgtagaaaagctcgactttatcgtgattaaccttgccttctttcaccattttatcccagtactgcttattcactgcaccgatttgtactgaatctgcttctactaagccgtaggttttatcgtgcgaaccgctgtaagtcggttgagcgtctaagtctttttctgggttaattccagcttccgttaagaaaaagcgaggcattaaatgacctgatgtcgaactttcgctaccaaaagcaagggtgtgacctttaacatctttaatctctttcacgttatctaagcctttttgcttgataaagacggacttaaatttttcatcttgcggacgttgtgcgatagcttcagcaccttgtactttggcacgagcttgtacccccgttaaaccaccgaaccagactaaatcaatttcgccacgacggaatgcggtgactacggcagcataatcggtgacaggcacatattgcacctttaaccccgtttctttgcctaaatactctgcaaaactgtcgaacgaacgggtcatttcggcagcgttatagtcaggaatagcactgattttaaaggttttatcggaaggtgatgcgatagcaactgagctaaacagcacactgagagcggtgaaagcagttgcaaaacttgcaaaaagcggtttcatggtgttctccaaaagaaatgtaaataaattgtaatgttcaaaatgaacgtgcaaaagatacgctattttttataaaaaacaagagatttctgcaacagatagaaattatagaaaaagttggcaaatggcgacagtttctctataatccgcagagttatactttgtataattttaaaggaacctatatgcaagtggctgtcaaaaaatggggaaatagcgtaggcattcgcattcctgctttattatctaattcattgaaattacaggcagagagtttagtcgatattcaagaagttgatggtcgcctaattattgagccgattaaacctaaatataatttagagcaacttctttcaggtattactgaagataatttgcacaatgaagtcgattttggcaagcctgttggcaaggaaatgctatgactactcaagagtatatccctgacgttggtgatattatttggcttgattttgatccgcaagcaggacatgaacaagctggccatcgtccagcattagtgttaacgcccacgatttataatcgtcaaacagggttgttaatttgctgcccgctcacaacaaaagtaaaaggctatcctttcgaagtcaatattgcaggtaccccccaaaatgttgtgctttccgatcaaattaaaagccttgactggcgtattcgtcacgctaaatttaaaggtaaaattaaccatcatcagttaagcgaagtaaaagctaaaattgcgactttgctacaaatcagtgaataatttctatggcattaatcgaatacaatccccctgttgaaccttggcttgacgaagtttattgtgataatcatattttagtgattaataaaccaagtggcttactttctgttcctggaaatcgccctgaatatcaagacagtgcgatggtgcgtgtacaacagaaatatggttttactgagcctgctcaccgtttagatatggcgacaagcggtattttgttgtttgcattaagcaaacaggcggaaaaagaactcaaacgtcaatttcgtgaacgtgagccgaaaaagcactatcaagcgttagtttggggcaaattaggcgaaaaagttggcgatacggggacaatgaattttccgttaatttgcgactgggaaaatcgtccacgccaaaaaatttgctacgaacggggcaaacaagcggttactttctatgaaattcttgcacattatcccaataacaccacaagggtgacattaaccccttatactgggcgttcacaccaattacgcgtacactgtttagccttaggtcatccaattgtaggggataaattttatgcaaatccgttggcaaaaagtctatcgccaaggctctgtttacacgcagaagcattaaccattacgcacccagttacgcaagaactgatgacatttgaagcgaaacctgaattttaaaaggtagatagaatgaactttcaatggcagaaatatcctgaaaatacgcaaaaattattcaaactttcgatcccgattttcatctctcaattagctgcttcgggaatgggactggcggatattattatggctgggttagtcagcgatgatgatgtgtcggcgatagcggtcagtaattcgatctactttcccttgtttttatttgtgttggggatattaaatgcgattactccaacggtttcttatctaaacggttcgagccaacgttccttgattgcacatcaaatccgtcaaggcgtttggattgtgttgatgctcagcctgccgttaatttttatctatctcaatgcccatttgattttagatctgatggataccccaaaagtcttttcaggaaaagcacaagattatcttaccgctttaagtgtcgggattattccagccttgcttgcggtgaacttacgctgttttaacgacggactatccaaccctaaaccagcgatgtacatcacctttttgggcttaattttaaatattccactcaactatatttttattttcggcaaactgggtatgcctgaattaggggcggtcggttgtggtgtggcaacggcaatcgtaaactgggtaatgtttgggctgattttacactattgttataccaacccagcacaaaaggatattcgtctatttgaaaaatggatcgaaaaaccctgtaaagcaaccttaagcaaactgttcaaacttggtacaccgatagggtttgcactgtttaccgaagtgatgctgtttgcggcatcttccttgattatctcaccgcttggctcacaagtggtggcaagccatcaggttgccttacaaaccagctcgctcttttttatgatcccactctcatttagcattgccacaaccattttagttgggcaaacgttgggagaaaagcgtgttgcagaaacaaaatatctgacttatcacgccatttttacgggtgcaatggtcgcaatgggactggcaatggtgattttactgctcaaagatctgatcccctatgcctttaccagcgatccgacttctattgcaatcgcatctagtttattgatttttgcagcgatctatcaaatccccgactctatccaagcggtatgcaatggcattttgcgtggttataaaaataccaaacctattttgctgacaaccttaatttgctactggttaatcggaatgccactaggcactattttggctcgcaccgattggatcgttcagccgatggcggcaacaggattttggctgacattctgtgtctgcttaagtttagccgcagggctatttttctactttatgcggaaaattcaggctatgccagaagagattttaattaaaaaactagagtctattaaatagcacttaaagttatgtctatcctttattgtaccagatagggatagacataactttactcattgtcattttatattaggtattcatatatagctgaattatccagcttatctctttatcatttatccgatacccctctttcaaattcggcccacaagagttcgaaccaataccactcattttataatcgacacacagaatgtgatacggcgatttttctagctcgtaatgatgttttttcagggtcaattcttcctgtgtataaggggaaaaattgaagctgaacggctgtggtgcggtaatctcgagatcttgggtgtgaagatattcacaaccgtagtgactgccgttttcctgtggtttgacgtagtcttgatgattttgctcggcagtggtttggtatagacctagtcggcttgcgtggtgtttgtcgatgtaactttcactctcgccatagccgaaatgtcctgatccatcaggaagatatggggcgtggtcgcaccattcccagataaaaccaccgcaagcccctgcatatttttcaaaggtttggaaataatcttctaaatcaccgttagagttccccattgcgtgcgagtattcgcagagtaggaatggtttggtttgtggctgttcaaaatagcgatccatatcttctgtgctggcatacatttcgctatgaaaatctaacggggtaagatcattgcgatgttcagaatgttgataaatggtactttcataatgaaccagacggcttggatctcgctgtttgatccattttgcactggcttcaaaattttccccgtaacctgcttcattacccagcgaccagatcagtaccgatgggcgatttttatctcgttctacattagcgtaggtacggtctaagattgcttgtttgtagtctgggtgtcgggcaaaatagcagaaattatctatcgtttgttgctgaatacgttggttatcatcttgttttgctacattcagtaaaatgctgtgttctggcgttggaacgtattgcatactggcatcgtggctttctatgtcactttcgctaatcaggtagaagccgtagcagtcgcataattcgctaaaccaaggggcattcgggtagtgggcggtacgaatagcgttgatgttatgttgtttcatcagcctaaaatcctgttctgcttgctcacggctgataacataacccgttaggggatcgctgtcgtggcggtttactccgcggaatttgatcgggtggttgttgagcaagagtacaccgtctttgacttcgatccgacgaaaaccgaccgcttgttcaatcacttcgtttccataggcaaggtgtaaggtgtaaagttgtggctgttcggcattccagagctgtggtttgtcaatttttaccttaaagtgatcgcttgtctgttcggcgattaggcgatgttgtggatcaaacagttggaaagtgagctgttgtggcgattgcagaaaggtacattcgaccgataaatccgcttgatctaatgcttcagacaggctggttttgataaagaaatcttgtagataatttggttctcgttccagcagataaacatctcggaaaatccttgacatacggaatttgtcctgatcttccaaatagctaccatcacaccatttaagcaccacgacattgagctgattttccccagagattaaaaagtcggtgacatcaaattcgtttgtgcaatgactgacctgcccatagccaacaaattgttgattgagatagagataaaggcaagcgtccaccccttcaaaattcagtaaatagcgttttgtcgatttaggctcgtagtggaatgtccgttgatatacaccgcaagggttatcgtgtggcacataaggcggttcgaaagggaataggtagttgatatttgtatattgatgctgatcgaagccttgtgtctgccagtttgatggcacaggaatgcgatgctcaaaaggctgagaaagaaaatcttcaggcaaatccatcacgctcgtaaaatagttaaattgccattcaccattgagtagggtaaataggctagattgttcacgctcaaggggggcgagcttatcttgtgtcgcaaagggaataaaataggcgtgatggggtgtggtgttaatgtgaaataaagtgggatcttggtgataatttggtaacggcataacatcaattccattgctaagaaatggcaaaatgctatcactcgcaatccctgacttcaatccattgcaatgtaacattttagaaatgtgatgaagctcacaattatttttatgttcatttctaaagttatagtttacaaccacattttaccaattcttaaactcatatatacaactgctttcaatacaaaaaaccattaatttcttaatatttggtgatcacaatctcaccgcttgcaaagctgactttaagtgtattactgcgacattctaccttaaatatctgttcattttggcggatttcgttttcacagggcttccctgccattagtaacgcaatctgattttcggcaatttgtagggcttgctgttgctgaaaaataagcgcgctttgcttattttgcgtatgttgccaacggctataagctaaatatatcactgaaaaaatcaacataacgaccattaatgatgtcaggctttctgctttaatgagcttattcatttgctaatatattccgtgaataaggcaaatagtgccaagatgaaaatttattttccagatgttgaataacttcttttttataactgagatttctttcttctcgtaaattatcataggtggaataaagtgtaccatacattctttttcttcctgtaagatcaaataaataatcggtaatgacaataccgtaaaaatctttttctaacttttcattaatatcttgtaatgcaatcacaatttttggattctctagactactttctggcaactccgctaaatgattgattttatatatttccgattgataaggtaataaattcaaccagttttcaattttatccacttgaatatatttttctttggttggtttaaaaggatcaaaaatagatgaaaattgacaatgaaaactgtatttcattaccttaaactcaaaaataacattagtctgtttctgattttggcattctatttcaggatctattgctaacttttcaataagttgatatttatcggtaagatattgctgataatagaataggctcactttttcttgttttaataagctatctttattgagaaaaatgactgcaaacagaccgcttaataatatcaaggtaattaataaaatactggctggataataacgtttcatttatcacttccatttaataggtaactataagcggtagctttatatcttagttggttatctttgctagacgagagagccagttctattttcaataatctattctgctcaagccactcaaaagataaattttcgacattataatcagacatatctgacatttttcgccagttgcctttttgacaatttgttaggattttttcacaatctgcttggtgacagaactgaatttgactatcttcataaataaaaatcgcttttttctcaaatttaaaaccaaaaaattctcggcttacctctttggtattatttacaccatttatttcgcaagattgttttttatttcgattacctacacagccatcactacttaaatcatagaaaaacattagacaatttggattgttcagtgaataacgcttattatcgtttacaaataaactataattggtttcttttctattttgtccttgataattaaaatgttgaatatgttgttgaaaatactcaagtaattggtgagtatgcttttgtaaattcaataattcccgttgtttgatttgattgcgatagctatcactataaaaagaagataaactccataaaataatgcaacctaaaaataaagataataatatttcaaccaaactaaaggcgtgattaacaactggtacgtttgcctttttgaataacattaatcactccattttgttctacttgtaagatttcatagattttatttaccgtaacccttaagcactttgactctaatcgcccagactttccatcaacattaataaaaactttgggatataaactattatttttaactacggcattttctgtttgatagagataataacttttttgaatatcacaacttgcgatattcaaacagttacaagcgatctgtttatcactgactttttcaatggcgaccatacaccattttttatctgctacattttggctgatagaaatagaataattctgtttttgatagcgtgctttagcttgaatttgataaataaaagattttatctgatcgatttcattatttaaaacgatatgatcttgtaaataaaataaggtgggggaaaagaaatagagtgcgattgccattatgctcatcgcaaatagagtttcaataatagtgatcgcacgaaacataatatctctcccaaagtgagagagatattagatgttgaaaggattttgtaaataggcaatttttattttttcgacatagatcgaaaaattagaaagatgttgtatcttggaatagacctacttttaagtctgtggcagtatagataattctgccatcaacttcgacttcgccatcagcaagccccatcacgagcttacggttgatcacacgtttcatattgatacgataaatcacttttttggcagtcggtagaatttgccctgtaaatttcacttcgccaacccctaaggctctgcccttgcctttaccgccgacccagcctaagtaaaagccaaccagttgccacattgcgtctaagcctaagcaacccggcattacaggatcgccgataaagtgacagccaaagaaaggcagatcttggttaatatctaattccgcttcaatataccctttctcaaacagaccttctttgtcggtgattttggtaattctgtccatcatcaacattgacggtgctggcagttgtggaccttcgctaccaaaaagttcgcctcgtcctgacgctaaaagatcgttgtaatcataacttgatttgatgttaggtgtacaagtgttcattattttgttcctgtaagaaagtagaaaagtccgttattgacggtttatgttacgtttgcttgataaacacatcttaacagacttttaaaatagcgaacagttgtaagctgacttgtcggatcagtgaccctttaacagtttgcgaattttgtggaaaatcgaaccgcttgcgtcttcattttcattctgttcgatcccttgatgaactaacgcgaaaagtgattttttctcactattttcaggtagatcttcatcataaaacggatgctgtaacagaatttgtaaggcttcaaagacatcttcgaccgcccaaatatgaaattttcctgcttcaatcgccgataatactgcaggttttaagctcaaatgggaaacgcataccgcaggaataatcaccccttgtttccctgttaattcccttgcttcacaaacattgaagaaaccttcaattttctgattaacaccgcccacgcttaacacattcccaaattggtcaatcgcccctgtcaccgcaagggattgtggcaacggcaacttggttaaggcactgataagcacgcagaaaatggctaacgatgaactatccccatcaatttcaccataagattgctcaaaggcaacggacgctgaaaacggaagctgtgtcggtaattccagtaaatttgccaagcaagattgagcgataataatccctttagagtgaatattgccccccagctccactttgcgttcaatatcgtgaatttctccatcaccatattgcacgttacagctaatgcgtaatggctcaccaaaactatggggaacaccatcaaactcgaccacagataagccgttaatttgcccgatggtttcttcttccgtttcaatataaagctgatgatttaaaatatcatttaaaacaaatttatttaatacaccagattgtttttctaaataatcaaaataatcttgaatatggttaaattgggtttgttttggataaaaatgttgtaatcctaataaatgtttttttaataatgtcggtgaaatagaaattaatgtttggttttcactttcacgaatataataatgtaaaagctgatttaaacctgttttagaaaaggttctatttagatattttttagctgaagattgaatatagcttccccattgttcgctattttcttcatcaatattcaaatacgactcgatttcagcatattggcaaaattgatataaatcttcatcataattatgtaacgttgcaatatcatctcgactacctactaatatcaatttgaattgagattgaataggcataattgcttcaggtaattttcccgcaataatcgggtcaaactgcccaaataaaagagcttgttttaatttatcccattgcacaatatctaataataatgcactcacatttaaaatcagaatacccttatgagcttgctcaattgcccctgccaccgttttaatttggttttccttttctaaataaaggctatatccaaataaactttggtgattaaattctgttttcaacacagtttgacaatgcaaattttcaaaatagtccgtgatttcatttaaaaattcgggaaataattccgttttcaaaatgagtgccgaaccaaattcactcagggcaaattgttgcattgcctgctgtgtatttggttgaaaatccaaaaatctcaccgcttgatcggtctgtttgaaaggatagtgaacgcttaatgattgcaacgataatggagatacttgcacaaatttgcctctttatagaaatttgcttcattatacctataattacgctatacttcacaaataattcggaggcaaaatgcgataccaaaaacttgaaattcaagaagcaagttggaaatggaaatacttgctgaaaaaatatcgtgaaggcgaaaatatcaccaaatacgacgaacagagcttgatcgaattgaaagttcaattattaaccaccttacaaaactcgcccgaagagatcgagcaatggattaaggcggaaatgacatctgagcaacgcaagaaaatgcgtcaatctattcgagcaagacgcaagcgttttttcaatgccgaaaagcaatctacccgtaaaaaatctatcgatttagaatacgccagctggcaacgcctgtccaagcaagccaaagaaatggatctgaccttgtctgaaaccattcattatttgatcgatgaattagagaagaaacagatttatgcagagcaagtggataagatgaaagcaaatttgaaggcgttgttgggatagcgtcatttaaaacatagggagtaacaggcaaaatggtccctaaaaagtagccttgaattgtgctttgtgtaattacttccctttcacctcaataatcatcacttccgactgtgaacctagtcgcatcggtatcccccaaaatccgtatcccgaagtaacaaaaaaatgtccattaccgattttttcataaccgtgagcaagtcggtaaataaagtgagtaatgatattcgctgggaaaatttgcccattatgggtatggcccgacacttgaatatcaataggcagttgagcatgttgctcaatttgtgttgggcggtgatccattaggaaaacgggtaaatttttatctaccagagccaataactctgctgtttcagggcgatttttcactaattcatcattacgaccgatgatcgtaaattttccgtctaaagtaaccgcttgatcccatagcacagtaatgccagctttagtgatttcttgataaatttcagcttcagccccaaaaaaatcgtggtttcccattgtggcatataccccaagcggtgcttttagctttgccaaatgcggttgcatattttcagcaagataggcttcgacattatcgtccataatgtcacctggaagtaaaattaaatccacttgttcttgattaaagatagttgctaacttatctagctgtttaccgccaaaaaatttccctaagtggaaatcgcttgcaacaccaattttgagtggctgtatgggtttatctaatgtgacttgatagtgaaccactttgggtgaataggcattgtaaatggtcagtccaattaaccctaataaaacaggtacatagcttattttaagccagcgattaaggttatttggcgagaatatctgtttgccgacagtataaatcccccaaaaacagaagctgataaaaaagataaatagaagtaatgtgagtattaaagcaattaagcggaagtttggcaaaatgcgtgtaacgtgcaatatcatcaatagatttgctgcgatatagacagaaaatgtgatgatcttgcgacttttatttggtaaatcgcatagcaaagttactgttttagaaaaactaaagagcagaaattgaagtgcgataactgaaacggcggtgataatgtaatagcgatattccatatttattctttccaagaaaaaaagcccaaccaaaacggctgggcttaaagtatagcaaatacaagtgtaaggagaaaataggtctttaattagcttattttgctaatttttgacgaatcgcatttgctaattccgggctaactttttcaaagtgagccatttgtctttctacgatttcagggatagtcacacctgataaacctgcagcaaagttacctgctaagcgatctttttcttccgctgtgaacaagttgtaaagtgctgctggttgtgagtagtaatcttcatcgtactcacggaagttaaagtgtgcagcttcacgctcaatttgtaatggtaattgatcgtgggttggcacataagtatcaaaacggttcggagcgtagttagggtggttgccaccgtttgcatctacacgcattgcaccatcacggtgagtcgtgtggtatgggcattttggtgcatttacagggatttggtggtggtttacacctaaacggtaacgctgtgcatcttggtaagagaacagacgaccttgtaacatacggtctggcgagaagccgattcccggaacgatgttagatggtgcaaatgccgcttgttctacttctgcgaagtagttttgtgggttgcggtttaattctaatacacccacttcgatcactgggtaatctgcgtgtggccatactttagttaagtcaaaggcatagttatgtttgtgagcatctgcttctggcataatctgcacttgaacagtccaacgtgggaattcaccacgctcaatcgcttcatataaatctttttggctagactcacgatcttcacctacaactttagctgcttcttcgttagtgaagaatttgtgaccttgttgtgttttgaagtggaatttcacccagaaacgctcgttgtttgcgtttacaaagctataagtgtggctaccgtaaccgttcatgtgacgtaaagtcgctggaataccacgatctgagaacaatgtcataatttggtgcattgattcagggtgacgtgaccagaaatcccacgctgcatttgcatcacgcaagttattttgagggttacgtttttgtgtatgaataaaatctgggaattttaatggatcacggataaagaatactggtgtattgttacccactaagtcccagttaccttgttcggtatagaattttaatgagaaaccacgcacatcacgctctgcatcggcagccccacgctcgccagcaacagttgagaaacgtaatagtacttcagtttgtgcacctggtttaaataccgcagctttcgtgtatttagtaatatctgcagttacagtaaatgtaccgtaagctgctgaacctttagcgtgaaccacacgctcaggaatacgctcacgagcaaagtgtgctaatttctcttgaaaccaaacatcttgtaaaagaagtggaccgcgtgggccagctgacattgtgttgtcattatcaacaactggcgcacctgctgccgttgttaaggtttttgatccgtgatcaaatggacatttatacatagtgaatttcctccaaaaatagcttattaataggttacgagtattatcattgatagttataagtttgtaaaactattgaattaataaaaaaatactattaattttcaacgccaatctttatttggtttatttataaatccgcctcatcaccacgatcttgtaaccattgtttgcgatcttcagcccgttttttagcaagcaacatatccattaattcaaaggttgaaacctcttcatcatcgctattatcttctaaggttagctgaactagacgtcgtgtatttggatccattgtcgtttcacgcaattgacttgggttcatctcacctaaacctttaaagcgttgaacatttggttttccttttttctttgcaagacgagctaaaatagcctctttttcagattcatctaatgcgtaatgcacctcatctttaccaatatcaatacggtaaagtggcggcattgcaacataaacgtggccattttttactaatgttgggaaatggcggaggaacaaagcacacaataatgtggcaatgtgcagaccatctgaatccgcatcagcaagaatacaaactttaccgtaacgtagttggcttagatcttcattgtcaggatcaatgcccaatgcgacagcaatgtcgtgcacttctgtagacgcgagaacttgatcaggtgatacttcccaagtgttgagaatcttacctctaagcggcaaaatcgcttgaaactctttatctctcgcttgttttgcagaaccgcccgcagaatctccctctacaaggaatagctcagtacgcattaaatcttgtgaaatacaatctgccaattttccaggtaaggcagggccactaaccaatttttttcgtacgacttttttttcggctctaaggcgattttgtgcagaactgattgccatttcagccagttgttcagcaacctgtacgttttggtttagccataaactaaaagcatcttttacactattttcaacataactcgccgcttgtcgtgatgataaacgctctttggtttgccctgcaaactgtggttcttgcattttaagtgatagcacatagcaacaacgcccccaaacatcgtcggcagttaatttgacacctttaggcaacagatttctaaaatcacaaaattcagccattgccttaaataaaccttggcgcaaaccattgacgtgtgtgccgccaagtgcagttggaatcaagtttacatagctttcattaatctgctcgccaccctctgtgagccagcttaatgcccaactcacagcttcagtttccccaatcacttcaccaacaaaaagaggatttggcagatattcatattctttcaatgcatctgttaaataatcacgcaagccatcttcgtagtaccacgtttcttgggtattattgatatggtcggtaaaattgatcgttaatttcggacaaagtaccgctttggctcgcaatagatgacgtaggcgactaaccgaaaacttcggcgaatcaaaatattttggatttggataaaagcgaaccgttgtgcctgtttggcgttttggacaagaaccgatcactttcagctcttccactttaacgccatttgcaaaagcaatggtataaatctcgccattacgtttaatggtgatctcaacactttcagaaagggcatttacaaccgaaatccctacaccgtgcaaaccgcctgaaaaggtgtaatttttattagagaacttaccgcctgcgtgcagttttgttaggataagttccacccctgaaattttttcagtcgagtgaatatccacaggcataccccgtccattatcaacgacttcaagggaattatcgctatgtaagataacatcaatttgattagcaaaacctgataacgcttcatcgacactgttatcaattacttcttgccctaagtgatttggacgagtggtatcagtgtacatacctgggcgaagttgcacaggttcaagatctttgagaacggtaatttcatcagcaccgtagcgtttttctgacataagtatctctttacagcctataggaaaacagagaaatcactctagtaagtttgagcgattagattcaatgaaaagattctttatattgattaaatgaaagaagatatatatggaaaatcaatcacgaaaattattaaattgaagaggctgccctaattcagcatttttcacaagctgtattgtcgattgtaaatcatcacgggattttcctgttatgcgtatggaatctccttgaatttgagtttgtaccttgattttagagcctttaataagtttaacaagctgcttagccatatcggacttaatcccttgttttaatttaatttcttttgtgtaaagtttaccatgatgttcactttcagaaggaatatctagggaagtatgttcaataccacgtttaatacagcatcctattaaaatttcaattaactgttcaagttgaaaatcagattctgtagtaacccgtataagttcatttttttcattaagttctattgtggcatcaactcctcgaaaatcataacgtgtacttaataccctatttgcattttctactgcattgcgtacttcatgtatggtaagttcagaaacaatatcaaaagatgacatcttattctccttctatgaaatcaaatcagagttttttcgcaattctaccatagcattccacaaactatgaaattaattcttataagatttcttgatgtattttattagattgaagaattgttgacgtccaagtctttaaagacgaaggctccaactagctccgattgattgttataggctaccctcggtgagctctttctgctgaacacttattatcaagtaataacaaacttaacaagattgaaataacttacgctatttgtaccttatatctccgcccgaaagggtaagttttatggcacatagctgataaaagccaaaagccacctcaatttctcaaggtggctatattcaataaatcaacgcaaattacgcttgacctttcacttctttacgaccattgaaaggtgctggtgtacctgctgctgccaatgcttcttcgatacggattaattggttgtatttcgcaacacggtctgaacggctcattgaacccgttttgatttgacctgctgctgtacccaccgctaaatcagcgatagttgcatcttcagtttcgccagaacggtgtgagataaccgctgtgtaacctgcatctttagccattttgattgctgctaaagtttcagttaatgaaccgatttggttgaatttgattaagattgagtttgcgataccattttcgataccacggcttaagatcttagtattggttacgaataagtcgtcacctactaattgaactttgtcacctaatactttagtttggtacgcaaaaccttcccagtctgactcatcttgaccatcttcgatagacacgattgggtactctttgcataagccttctaagtagtgagtaaattcttgagaagtgaatgatttaccttcacctttcatttcgtataaaccgttgtctttgttgtagaactcagaagacgcacagtccatcgctaaagtgacatctttacctaaaacatagcctgctttttctactgcttctttgatacacgctaaagcgtctgcgttagaagcaaggtttggtgcgaaaccaccctcgtcacccacagcagtatttaagcctttcgcttttaatactttagcaaggttgtggaatacttcagcaccgatacgaagtgcttcttttaatgttgatgcacccactggttggatcataaactcttggatatcaacgttgttgtctgcgtgctcaccaccgttgatgatgttcatcattggtaatggcatagagtacacgcctggagtaccgttaagctctgcaatgtgagcataaagtggtaaaccttttgatgctgcagccgcttttgcgtttgctaaagaaaccgctaaaattgcgtttgcaccaaatttagatttgttatctgtaccatctaagtcgatcataatttggtcgatttcagcttggttagatgcatctttacctacgattgcatgagcaatttcgttgtttactgcagaaacagcttttaatacacctttgcctaagaaacgtgctttgtcgccatcacgcaattctaatgcttcgcgtgaacctcttgatgcacctgatggcgctgctgctaaaccaacaaaaccaccttcaaggtgaacttctgcttcaacagttgggttaccacgtgagtcaatgatttcacgaccaattactttaacgatttttgccattgttaatatcctctatgagagttaatagttaatgttgaaaagacttgcatatagtaatgggattttacaaatttgtcttgtaaaaaagtgatgagcttcacaaaaatttaagggatatttgatcgaagagggatttttctaaattaagaccaattatatattcaagtattaaataccgatatagacttttttctatcatcattaatatggactaagctatataacatctaatctacttttacgatcactggcacaaattcttccttacgtaagaaattttgttctctaaagttaatcggaaaatggcaggcaaattcgtgttggcggaatttgcgtagcggtggtttaacgacacattttttctgcgcaaaagggcaacgaggcccaagacggcaaccaataggcatatcttgtaacattggaactgagcctttaagggtattcaagcgacctttaaaaggcaaaggtttagaaaaatcgggtacgctatgcaatagtactgcggtataagggtgataaggggtttccataatggtttctttctctgcaatttcaacggtttgcccgcagtacaaaacgttaaatgaatctacccacttgtaaatactgagcatatcgttactcactagaataatagacgtaccaagatttttgttcatactggaaagcaagcgataaatttgtagctgtgtggttgattccattgtattggttggttcgtcagccacgagcaagcgaggctgatttgccactgccattgcaatcatcactttttgtgcttcaccttcggtaatatccgttggatagctttgcataatatctttatgatcttttatccccactttgtgtagtaattcaatggcttttttctttttccagccaaaacgttcccaccacttgcctttaaagcggatagtttcgattaattgtttaccaatacgttcgcttgggtctaagcaagagagtggatcttggaaaatcattgaaatctgatcactaaccagttttcggcgctgatagggggaaagtttcagtaattcaatatcgttaaagcgaaagcggtcggcagtaatgatccactcgtctttgactaatccgcagatcactttagcaattaaactttttcctgaccctgattcgccaactaaaccacatatctcaccgctatcaagggtaagattgatattatctaccatttttatacgcccgtttggcgtatcaatttcgatacttaaatgtctaatatccagtaatgccattgtttcccttccctaataacgatatttttcaagcacccgtacaatgctgtttccaagcattgtaatgataagtagagtaaaaatgatagcaaatccaggaagaatgaccgtccaaggggcaacataaattaattcaagagaatcgcggatcatcgctccccattctggcgttgggctcgttgcccccagtgaaataaagctcaatgcactgatgtctaacacagcaataacaaaaatatgcgcaagttctttgacggcaatcacagttaaattaggtaagatcacttcacggattaaatctcgttttcttgcaccctctaattttaaagtgatgacatattctctcgccagctcccgttgggtcatttgataaattttatggataaagtgaggcaacatagcaagaaaaatggccaacattgcattaatgagagagacctccattaaagttgcaatgatgatggcaatcagcaaaatcggcgtaaataaaaaggtatcaaaaagatgactgagaataaaaatagatccactccgttttgtccctgcaatcacgccaagaatgccacctaaaataccgatagcaatggtaatgaccaatgctgaaccaacggtgtagtagaagccgtagaggacgcgactgaaaatatctcttcctagatcgtctgtgccaaaaaaatggctaatctgaccgctatcactccacgatggtggcattaattccattccgctaaattgccgatcggctgcataaggggcaagtaaatagccaaaaaaaaccaatcccatcagaagaataaagagattaaggctgatgagtgcaaaggtgtctttcctcaactctatccaaaattggcgtaaatacgcagattctcgaaactgttcggggtcttgtgcgagtagcattctttattacctttttactaatactgaatataacaataacatcttttactcttaattcattttttgatagacagtatagcattctattcttgttctaacatcgccaacaaatgttgtttcaacatcgcctgttcttcctccgccaacgccccattttgctgattgctcaccacaaaaaaatcctccacccgttcaccaatggtcgtaattttagcgttaatcaaattcaacttaagctgcccgaaaatatacccaatttgagccaacaacccctctcggtctaaggtaaatagctcaaaagcggtctgatttggctgggaatttgctaaaaaacggatcttggtttttcgcttaaacgcctgatgtttaacggattttttacttggattaaacactttctccgtattcgcaagcaaagttttaaccaatgccgactgaatttgttcacttcgctcatcatcgagtggctcgccgttcatttccgtaataataaaactatccaacaccaaaccatgatcgctcgtaaggatttgagcatcgtggatactcactttcttctgacttaacgtctgtgcaattctcgcaaaaagctgggcttggtcttggcaatgcacaaaaatttctgtcgctccccgtgcatactgattgctaatcaacaccatcggcaacgcaggatcttttaaataatgcaaggcgtgccaataaagctgtgtcgggctgtttcgcacaaaatagctttcaggacaggattgccaaaattgcaacagccgtgttttttgttcagccgaaagtaacgcctcaagttgtacataggcttgctgttgatgggcttggctcagttgctgatgattaatcgtttcctcactgcctaactgcaactgctgttcggtaaattgaaaaagtttaaggaaaagcgaccgcttccaatcattccaaagggtttcattcgtcgcacaaatatccgcaacggttaaacaggttaaagcagctaaagcggtcggatttttcaccacatttgcaaaagttttcaccacatcgggatcgtgaatatcccgacgttgtgccgtaattgacatcgtcaaatgctctgccaccaaccacgccatataatcactttgctcttgagaaaagccgtgttgttgagcaaaagcacgcatatcttccgccccaactttagcgtgatcgccctctctgcctttagcaatatcgtggaacaaggctgacaaatagagcaacggacggtctgccagtgtcggaaacagacgacaacaaagcggatgtttttcggcattttcctgttgcagaaaactttctaatttaagcatcacctgaaccgtatgctcgtccaccgtataaatatgaaaaagatcaaactgcatcaagccttgaataccaacccattgcggtaagtaagcggttaaaacgcccaactgatgcattggcataatggctcttttaaccacatcaggctgagaaaacagccgaataaagcgatgtcgagcttgaggcagttcacacaacggctggtttaaggtctgtaacgccagccgaagttgtcgcaacgtcgtactggctacacgcacctgcgtatgctgagtgagatagaagaaaagatccaaaatccgctcaggttgttgcttaaaaatcaaagtgttactacaaattagctgttccccttgcaaataaaaatagtcatcaagcggctgtttttgctgtacattttgcaaagcctgtagcacctcttgatgaaaatgattgagcaacaattgcgttaattgcgaaatagattgcgtcgcctgaaagaaatctttcatcatcgcttccacaggctgattaccctcgccctgatagcctaactgctcactcagttgtaactggcgatcaaaccgcaagcggttatcgtaacgctttaattgcaaatgcaaggcaaaccgcattctaaataacgtatgttgagcctgctgaagctcaataaattcttcaggatagagcaaaccccgactaaacaaactctctaggctatatagcccataatggcgtaacataatccaagagagcaaatgcaaatcccgtagcccccccggactatgttttaaatcaggctcaaggttataactggtattatgataacgggcataacgttcatttttttccgccatttttgcttcaaaaaaggcttgaatagaccaaaactccgcgtggaacagcttgctcatcagctgttgccacaaggcttcattgccaagcaaaaaacggctctcaaacatattcgttgccacagaaatttccgctctgcccacctcaacacactccgccaaggttcgcacactcgcccccagctgaaatttgcaatcccacaagaggttaaatagttgatttaattgattttgcgtctgttcatctaaaggctgttcactcaacaccaaaatatccaaatcagacagcggaaacatctccctccgcccatatcccccgactgccactaaagccaagtcctgccgctccatcaacccaaattgttgccagagcgttgtcagtaaatcatcataaaaatggctacgttgttcgagtaaatttttgatatcttcagtactaaaaagggatttttgtgtgctattaaattgctgaagttctgtttttaaagtttgtgtatcaatcatagcggtgagttttagcattattttacgaagaattgtaatggatttctgagcgtccaccaaagaggatttttaaagtaaattgtatgaataacaaaatttctttttaggctgaaattcccaaaatctcaccacttattctatgttagaattctagcaaattttcagacaaggattttcaatgagcaaacagggtaaaccatttattttacattcccccttcaaaccctcaggcgaccaaccgactgcgattgccaaattagtcgagggattgaatgatggcttggcacatcaaaccttgctaggtgtaacaggatcgggcaaaacctttaccattgcaaatgtgattgcgactttaaaccgtccagcaatggtgcttgccccgaacaaaacccttgcggcacaactttatgccgagatgaaagcctttttccctgaaaatgcggtggagtatttcgtttcctactacgactactatcagcctgaagcctatgtgcctgccagcgatacttttattgaaaaagatgcgtctatcaatgagcagatcgaacagatgcgactgtctgccaccaaatcttttttagaaagacgggatacgattgtagtcgcatcggtgtcggcaatttacggcttgggagatgtagatgcctatatgcagatgatgttacatctgcaagtgggcgagatgatcgaccaacgcaaaattctctctcgccttgctgaattgcaatatacccgcaacgatcaagcctttcagcgggcgactttccgtgtgcgtggtgaagtgattgatattttccctgccgaatcggacggtgtcgctctgcgtgtggaactgtttgatgatgaaatcgaaaatctgtccttattcgatccgcttacagggcataatttagggcgagttccccgttatacgatctacccaaaaactcactacgttacgccgagagatcggattttagaagcgattgagcagatcaaaaaagaacttgccgagcgtcgaacttactttatcaaagagaataaattactcgaagaacagcggatcgcccagcgtacccagtttgatattgagatgatgaacgagttgggctactgctcaggcattgaaaactactcacgttatttatcgggcagaaaagagggtgaaccgccaccgaccttgtttgattatatgccgtctgatggcttgctgattattgatgagtcccacgttaccgtgccacaaatcggcggtatgtttaggggcgaccgagcaagaaaagaaactttggtgcaatacggtttccgtttgccatctgctttagacaaccgtccgttgcgttttgaagagtttgaacgcttatcgccacagacaatctatgtatcggcaacccctggaccttacgaattagagaaaaatcctgatgtaatcgaccaagtggttcgtccgactggcttgttagatccgattatcgaagttcgccctgtggcaacgcaagttgatgatttattgtcagaaattcataagcgtgtggcggtagatgaacgagtgctagtcaccacgctgacaaaaaaaatggcggaagatttaacggactacctagacgaacacggcgtacgagtgcgttatctacatagcgatattgacacagtcgagcgggttgaaattatccacgatttgcgaatgggaatgtttgatgtgttagtcgggatcaacctactgcgagaaggtttggatatgccggaagtatcgctggtggcgattttagatgccgacaaagagggctttttgcgttctgaacgctctttaatccaaaccatcgggcgtgctgcccgaaatctcaacggcaaagcgattttatacggcgaccgcattactaactcaatgcaaaaagcgattaccgaaaccgaacgccgccgagagaaacaacaaaaatacaacgaagaacacggcattgtgccacaagcgttgaacaaaaaagtcagcgagttgttggatattggacagacggataaaccgaaacgcagtaagaaatctgcaaaatcaagcgatgatcagaccgcttacaccccgaaatctcgtaaagagttagaaaaagaactgaaaatgcttgagcaacagatgcgagattttgctaaagatcttgagtttgaaaaagcggctgcggtgagggataagattcatcagttgaaggcgtatttgttagaactttaaaagtaatttaaattactcataaagaatactaaccatattgagatttatacagtatcaatcacaaactcaaaccaatcaatcacatctttttcgtgaatgccgttggggattaacacccctgctctttttactgaattgggatcttgtgaaatcagtgggtgccaatcaaacaacggcttgccttcataaatcagtcgataggcacaggttttcggcaaccagccaaaatcgggcaagttctttttagtgagtttggtgcaatctttttcgattttgaaacgctcagcatagttagtacaacgtcctgtatctacatcaagcaagttacaggagacggaagtgtaatacagtcgctcccgtttgcctctgccttgaatatatttgcgataacaacatttaccacagccgtcacacagcgcttcccactctgcttcattcatttcaagcagagttttggtttgccaaaaaagcggtgtgatttgaagatttttttgcaacattaacgaatcacaaccgctgtgcctgttgcaaccacaataaacattcctttgtcaccgcccatcgattgatattccatagacacaccaacaacggcattggcaccgatctttttcgcttctttttctaattcttgcaaggcttcttttctcgcactatttaatttgctttcataagcacctgaacgtccgccaattacgtcagtaatgctcgctaaaaaatcacggataaagtttgcacctgacacgacttcaccaaagactaagcctttgtattcaacgatttgatgattttcaacattcggagttgtggtaataatcataatgttcctatttcaattgttgtttcagggattgtaatgcaatcgctctatgggatatttttttcttctcggcggtttcgagttctgcaaaggtgcagtttttaggcggatagaaaaagagtggatcgtagccaaaaccgtttgaaccacgttcctcacgtaaaatttgtccgtaacattcgcctatcgcaattttcggggtaggatcggtcgggtgttgtaacatcacaacgcaactgacaaattttgcaatgcgatcttcatcggcaacatttgccatttcagcgagtaatctttggcgattggcttgatcgttcccttcttcacctgcataacgagcagaataaagccccggctcaccgcccaatgcttctaccgctaaacctgagtcatcggcaatcgcaggtaaccctgtcatttgtgacgcatagcgagctttaatcagtgcattttccacaaaggttaagccagtttcttctgggctttgaatgccaaattcactttgggcaattacttcaaagccaaattcagctaacacatctgccatttctttcactttgccttgattgcctgtggcaaggacaattttggtcttgttcattttattttcctgtttttgcaaaatttttatcaaatcagaccgcttgttttaatacaaactcggatcgctctcattcggtcgggttttaaaacggcgatgtagccacatatattggctctgagcttgcataatctcgccttctacgaccttattcatcaaagttgcggtatcaacgtcattttcacactggctaaaatcaactggcgggctgattttgacggtatagcctgaaaaatcctcgtttcgcattggagtaaacggcacaacgatactatttgaagcagaacgtaataacattctcgtaccagctgtcgtacaggcttcttttacggcaaaaaacggcacaaagacgctgtttttgcgtccgtaatcgtgatcgggggcataccaaatggtttcgcctgcacgaagagctttaatcataccgcgtaaatctttgcgatctaacattgctttgttagaacgtactcgcccacgaaattgaatccaatccaacagcggattatcattaggacgataaacaccgatgccttgacgctgtagtccaatcattcttgcaccaaactcaagcgtcagaaagtgaacaccaactaaaataactcctttaccctctggctgatttttcagatgttctgccccctccactttacatagtttaagaatacgttcatctgaccaaaaccatgccatacctgtttcaataattgccataccaacggattcagcgtttttagctaaaatctcatcaatttgactagtggtataatcaggaaaacaaagttccaaattccgtttggcaattcgcatacggcgtttaccaaaacctaagcgagtaaacagtttgcctaagcccttaccgacttttactaacatagggtaaggtaagcataaaatcagtttaaaaattcctaatccgaaccataaaccccaatactttgggtgtaaaaaagctcgttgaaaagggggaagttgtttatctatcattatattgtttccattgatttcactgacaagcgaatccactctaatgcgatttttcgatgagcaatgaataaattatacacggcatcttcacttaataggcatcgaatcatctctgagggaatttcccctcgttcatctgcattataatcttcttgccactgttcagcataataattttctagctctcggatttttggtaaaagaactatccacgactgttgaagctgttccattttattcattaggctatttgcttcatttaaaatctgttccatttcatgaatttttgccaagcgagtttctgataacataaatacctctcacaaatatcgttggaattatagtcaaaaaaaccagaaaagtgttaagtagatcaaatttttgaaaattgtttaactttaggggttgaaattttagggggaaaggcataatttgaagtcatccattcaacgaccaacaaggtcataataaaagaggtacatgctatgacaatcaatatttcaagcaaacaaatggaagtgactcctgcaattcgtacgcacattgaggagcgtttggctaaactgaataaatggcaaactcagttaattaaccctcactttattatccacaaattaccaaatggttacgaagttgaggcttctattggaacccctgttggcgatttatttgcaaaagcacatgatgaagatctctataaagctatcaacgaagtagaatcaaaacttgaaacccagttaaataaacaaaaacataaaggtgaagcacgcagagcagatgatagtattaaaaaagcgaatgaagcattatagatggcgtaaatatttgtatctgagataacatatccaagcactgttatttgtacatctatctctaattctaagtatcttcattttaaacttatggtggtcgcttaggcgatcaccaaaatcaataagctggctgtttctagtttagagttagcatgcttcatttttgccacctcattaattgcggcaagtaggcaaatttgtttgctgatctgccaaaaactatgctatttaaaatgtcacatcatcaattggaaatacatttctttccttaattactcgacggattacatcacctagagattcaataacacttgtcgtataatatgccgaattcctgctcacctataaaaatacctgtatctagatgtattatcacagaaacaggtatttacacaaatttattctatgctctatagaaagttagaacttcatctctactgaaaggacatagtttctaccaggtgcggcatatcttacgtaatctttcacattagtatgctgatgaatcgcattaagcgaagattgacgtacggattcccaagtggtgtaacggtaattcatcagattatatacacccgctcgtaccgttacatgtttccaaggggtgacatatcctgttaagtcaaaggtatgccaagagcgtgttcttttcttcgtggcagttcgttcataattggcaaaaccgacttgttcattacctcttaactcatctggattttttccgctagagtgagtcattgttagattcacgccccatttttcatctggttgatcgtaaccgatgcctacgacatagcgagcaggctggatggtgtctaacaatggggtacgaatattcatatacccttgataattttttacctcttttactcgcattttgctataagccaatgttgtgtaaatgccctcaggaattttatcaaataccccattccaatctagcttaccaataagattaatgccgtccaatttaatatcttgcacattaaaatagttaatcattgattgagtttggtgcattctttctgctggagcaatcaactgcttataatcatttttgaaataactgacttcaacgataccaaaatcacctttgaaagtcgcagcaacctcttggtttaaggatttttcaggagataacttctctgttttttggtaagcatcgctggagcctgctcttgcaccatcatagcgtaagccaaatagctcttggaaacttggcactctaaagcctgatgatgctcgataagagagcgataggaatgacgttggttttgcgactatgccaatattccacgcactgtttttataatcgccttgatttgcccagcggtgagtactgcggaatttatgcttatcgaaacggtagcctaaaccaatatccaaatatttggttatggcaaaattatctcgcagagcgatgtagtgattatgtcctttgattttgcttgtagcacaatcagccctgcctgcaatagtgccactataattacattcatttttactataaattgcctgatcttttagctcatagatgtaaggattattttgataaccgttaccattaatgcgatgccaagttcccacagaaaacttactcaaaatttcgtggcgttttaaggtggaattgaaacggtctgaacctaataacatatttaattgatgtttgcccaatcccgtttgtacggttttatctaacgagagctgaatagtatcgtgtttttcttcataagaactttgctcatttttagttgaggaccaaagtttatcaagagttgcacggcagttcttatctatggttggatattcggaacagttgttctctctcaagcgggtagataaatcaattttttgctgatcgaaactcaaagagaggctatcaatcagacgatctttatcttgattggtatagcgatataaagcacctaagcgatcacgagtgtgccactcatcaataaaacgagcttttgcccaacgtaatccttttgaggatttcacaccatcttctgtaaagtaatcaatagcaacaccatctaaagcattactacgatataaccctttagcattattcattggataccacgtattaccattttttaaatctgatagctgccaataagcaggataggtcatatcgcgagtatcatagcgttgcttgctatgttcataaacaccagccacataatgttttggtgaaaggctataacctaatttaaccaaccaagaatcagatttatatttcactggatcaggcaaagctcgttcttcacctgtatattctttagcactaagttgctctgttagatacttttgcccatcataagacactttagcctgctgacgtggttcgcagttcaaacttggacaatcattcttaactttaaaccaattgctatcttgaggattattgtctgcgagatccactctttgaatacgcttagaacgactttccgcatccttatgagctttcgtttctttaccatcacgatgagtgtaaatcacaagtgcatcaaagccattatgggtaccagcaaaagcaagtgagtttagccattgctgatttttactactgtaagcacttttgctatccaatccccaagattgccctggcttaataatgtcgcttacctctttggtacggaattgcaccgaaccgcctagcgaaccactaccaaactcagaagaactagcccctttactaatttggattgaacgcagattttcgtattctatttcattaatggcaccgcttgaggaacgtgaatattcgcttacataggattgaatctgtggcaacccatccaatgccaagcccacacgattacgatctaccccacgaatggagtagcctgttgttgcacctcgcccttgttctaccactgaaataccggggtcgtaacgagtcagatctcgcatccctaacacttgatctttactgagtgagtctggcgttttcaccactttccctaagcctgtcacttcgttctcttttttatgcactttctttttggtacctgtgacataaacatcgttcaattgtaccgcttgttctgcatagctttgtgcggcaaagaggctaagaatagcaaggctaataagatttaatttatttttcatagcaaattccttattatttttttacttgttgttttgcaccaaagacagcacctacactgccattgtctgatttatggaagaattgtccgccaagctctgctgccgttggaccatagaagccaccattaactgctacatcgctaaatttcacattgtcataacgtgaactgcctgagtctagagcgaagccagtatctgaggttttagcttttccggtaaaaccattaccattaatttttgcatctacggtaaatacaggatttacaccgtttttatcaaataacttaccgcttaaatttttgttgccaaaatcaacatcaaattctgtgcgatagccagcctttctatcatcatctgctgtagcaacccagttattttcttttgaaacctgagcatcccaagtaccaatatatttatagtttccgccttttggcatcttatctgttgcggtacgttcgccttgtaggaataaactatgatctttaacttgttgttcgccctctacttgttgccataattgaccaaacttcatatattccagattactacagcaggctacggctaccatttttttaccattgatatcaatagtgtgcttatttgtaaacccgctaccagctagctccatttttttcccatcaataattaaaacggaagcatcaccaaaattgttaagttctgaaatgctgaaattagttaaatcaatttttgaggcatcaataatacgaacggtgtcaacattagagccattgtgttttgctgaaaaaacggcaaaaagagatttgtcatttgtgataaattttcctgcaagttcttctgccttaggtccatagaaaccaccttcaagataatcagaagacttacctaaaattgcatcactagtgtctttggctattgctttacctctaaaacgatttcctttaagttctgcttcaatactgtaacgctctaatgattctgcatttgctgttttgctatttaattttccttttaatttttttgttgaaaaatcaacttcaaattcagatgtataggttctacctttagcatttgcagatgttgttgcaattctctgccctggaccatacccactaaattcagggttactattaggtcttttggcatctaaattagcatctgatgtaaaatcccattcacctcggtaagtaagggtttgtccctgcggtaattcttttgagggagtgatgcctttataaaacacataacctttatcacgagtaccataatgatctacatcaattgcataaccagaacgaacatacttcatcgttttatctgctgttttatctactacccagccataattttgattagctacacctttgataatctcgtgatttggtattttcttaagatcttcatcagtaattgcttctggatttgagatttccgttcttcttgctccactttgactcaccggaacttttacaacataccccaaagcaggttccatcaattcccctaactgttcttttactttcttatccgtttccacatcctgatactcttctttagacacgcccgttgtcttattaggctgaacatcttctaaatcaaaacttccttttccgccagaacaagcgacaataaacagcgaagtaaacgctaacgcatagggattaagtttaaaatgcatatttgcctccgatataaaaacactgcatttatttagttggttgggttacaaagccaattttggttagcccaacattttgagctaattcaaggactttcacgatatgttgatattccacggaaatatccgcagaaatagcaataacggtatttttattttcctgaaattttgtcagaaaagattgttttaattcttcttcattcactagcttttcgcctaaataaatgccagtaggattaatcgccaccctgaaaatatcttttgcttcatcttttttctcaacattggcggttggtagttcaagcgggatagattgcgttaatataggcattgtgatcataaaaacaattaataacaccaacattacatctactaatggcgtgacattaatttctgacattaccgaattttcatttttatcaaaacttccaaatgccattatttattttctccatagtgatgtaataaatagataaataactcgtttgcgtaatgatctaaatcttgagaaagattacgattaaggcgagtaattaagttataagcaagcaccgcaggaatggcgacaaataatcccattgccgttgcaactaaagcctcacctataggggcagatacggttgcaatactgacttgcccttgctgactaatatccataagtgcattaaaaattccccagactgtgccaaataatccaataaacggcgcaactgcaccaatagaagcgagtgcaactaaaccgccatcatatttacgcaacgattgagtgatggcatttcgcaaatgcaatgtcaggaaatctttaaatggaagttgatgagataaatggttcttttctttagcttgatataattcacattgtttaaaagttagctgtaaaatatctgcaatttcagaccgcttgttttgaatatattgctctgcttgagtaagattttcagcagatttgactaatttaaaactttgttggttatttttcttacaccaatcattttaattaaacgaattaaaataatagtccaagataaaatactcattacaactaaaattccaaaggaaatggaaagtacaatatcttgttgttgaagaagttgaattaaattcataaattacctcaaataatttaggctgctgccccacatttaaaatgaatactaaaaatcacactgcctaccactgcactattatttattttggctggttgataggtgtgtcccgatgccattctgcttgcttgattatccaaacgtttaatacctgaagaagataaaatctctacatttgtcgctttaccattcgttcctattgttacctttaatttcacactgcctacatcatcagattcatcagaaatatctgaacaacgccctcgcattgcattgccataacccgcaccaagagaagcatctactttggcgtttccggtcacagacttactcccttcaacaccattttgatttccttgttgatgattttgggcaacttggcttgtgtttgtttttttatctgatagaggtttaggcgataactctttatttttctctacttttttggtgagcttttctggggatttttttatctcttttttcacttttacttcagatttctccccttttttaacgagatctgcttgtgaaacatctgctacttctgtactgagtatttgctctggctcttgtgtcacctctggctcactttcacttttcacttcaatgggttcttcgcttcctaaatttacttcaaccatttgtaaattttctaagtccccaaaatgattgagatctctatcccaagatagttgtgaaatcgtatatgccaacccgatatgaacaagagttacagataaaaaaatcgaaatgttataaaacctgttataaaaccattgcaacataatatatgagtatattagaataaatccagtaatcaaataaaaatcattatcaatatgatatctgataagtttgacaattacaacattaattcaaacaatgtaagcgccagttaagttattgttaataaaaatcaacagtcttgacattgcttcatgcttttataggaacgttatgaatcactcgtttattagcgcaacacttttattagtcttagctaactactctatagcaaaactatctcaggatagtattactgaacatctaaatgataatagagtccaagcagaaaaagccgatatcctcattcacagccatcaatttaaggttcatcaaatcgctaaggaggaaacggataagagtagtattacaatgacttcaaaagagttggtaaaatatccagatttagtgataagagcattattgcctgcggtaatgcaaggtaatattgacaatgtcgaattgctttatcccatttaccaacagcttcctgcacaatttcacgacccaattcttaccaaatgggcatcggcaattgtggcaaagaaaaatcagcaacatacggaagcgatcaagttatatcgtcagatccttgccgaacaagcagatattcagcctgttcgcttacaacttgcagtagctttatttgaaaataacgaattggaggcttcggaagatcagtttaaaaaactgcgttcagaaccgcttatccctgaaattacccaacttatcgatcaatacattaatgcgataaatcggcgagatcgttggacgttttcaggtgggcttacttatcttaacgatcctaatatcaataatgcaccgaaagcaggaacaacctacggcaactggcacgcaccaaaacgagaatcggcagaaggtgtcggttttaatttcgatctcggtaaaaaatggtcgtggggaaatggtttctttaatgaactacgtcttgctaccaacggcaaatactactgggataataaaaaatacaacgaaatgagcttacgaggcagtgtggggctaggttttcaaaatgcaaaatataacctgaggctgttgccatttatggaacaaacactttatgcaggtggctctaatcaaagtgatacattaagacgtttttctaaatcaggcggtttaacccttgaaacaaactattggttatcacctaaatggcaactcaacgctaactatgaatatgccgaacaacgctacgcaagtcgcttgcacctcaatggcaattatcactttatctctggtgggctagtttatttagccaatgcaaaccaatattggtttgcaaatttaaactacaatcgcaccgctactcgtgataaaaacgatagctttttccgtcggggaattagtttaggttgggggcaagaatggggcagagggttttctactcgcctttcagtaagtgtggctcaaaaacgctataagggagcaacgattttcaacattattcaacgtaataaagaatatggcttcaatgcatcaatttggcaccgtgccgtgcatttatggggcattactcctcgtttaacctatagttttacgaaaacacaaagtaaccacgtcttttatagttatgataaacatagggtgtttattgagttgagcaaacaaatttaaacttattgtttgttatacctctgcatctcactctgcaaatccaaccccttcaaccacgccattttttctttgatctgcttttccattccacgttcggttgggaagtagaattgagtgtctttcagttcaggggggaagtagttttcccctgctgcgtaggcgtgaggttcgtcgtgagcgtagcggtattcttcgccgtagcctaaggatttcattaggttcgtcggtgcattacgcagatgttcgggaacatcgtaatctttgccttcttgggctaggcgtttagcttgtttgaatgcggtgtaaacggcattactttttggagcaacagcaaggtaaatcaccgcttgggcgatggctcgttcgccttcgtaagcccccactcgagtataacaatcccacgctgcaagggcgacttgcattgctcttgggtcggcattgccgacatcttctgaagctatcgcaagtagtcggcgagcaacatacagtggatcgcctccagcggttaaaatacgagcataccagtacaatgcaccgtcaggggaagagcctcgaatggatttatgtaaggcggaaatcaggtcgtaatagcggtcgccacctttgtcaaaacgggcttggcgttcgcctaacacttcggtgagcaaggctttatccagtaattttccttgtggtaattgctctgccatatcgcacattaattcaaggcagttgagagaaaaacgcccgtcaccattgacataatccgccagcagttgaagcacatcatcttgaatgatgagcttttcattgcctagtccacgttctttgtctgcaatggcattttgcaaaatttttagaatatcgaccgcttgtagtggcttgagaatgtaaattcttgcccttgatagcaaggcgttattcagttcaaaggacggattttcagtggttgcaccgataaaaataatggtgccgtcttcaatatggggtaaaaaggcatcttgttggcttttgttaaaacggtgaacttcatcaacaaaaagtaacgtgcgtctgccagattgtcggttgagtttggctttttcgatggcttctcggatctctttgataccgctagtaacagctgataggcgttcaacttcggcatcaagttcatttgcgataatttcagcaagggtggttttgcctgttcctgggggaccccagaaaatcattgagtggctatgccctgcttcaatggctcggcgaaggggtttgccttcggcgatcaggtgtgattgtccgacatattcagctaaagtgcgtggtcgcattcgagcggaaaggggacgaaaatccgcagaaaaatcgaaagataagctgttcattagcgtaaatgtagccctcggcgtatatgtcgcatcagtaagaaaatccacggccataagataccgcttatgatcgccccgatgatttcttgggtgttaaattctgcactatgtagcactagttcgataaagaagataaagaaacgaataagtgcgatatatgccatcacaagtaagctctgtaaccataacgagagattacgcaagataagatgatatttggcaacaaaatagatcgcaattgacaatactaacgcgtgaatgcctaaaattgagcctaagatcagatcccaaacaattcctgctaaaaaagcggtgccgacactaactttatcaggcagagctaatacccagtagataagtactaatacaacccaagttgggcgtaatccttgtaaatccacaggccaaggcataatctctaggacaaaagcgatgacgaaaatgaaggtcagcactaacatttggaagatcatattttcacgcattattctgccccttgctctgtgctgtgattaataccgttatcgacttctggctgtgttgctggatttacagtttcttcaggttcgacagtttcttctttttgttcatcactacttacttgttcttttttactatttttcaagcggtctaatgggtttagacttttacgtctttcttccacagcatcacgcacatcttgcggtgaaaggcttgatgcattgcggatttcttcgcttgttggccataacagtaataaataacgcaggcgatcaagtgaggcgagcggtctagccgttgctctggcaaaatggtttgaaccatcattttgtacggtttcaattacggcaacgggatagccttcagggaaacgtccgcctaagccagaggtgacaagcacatcacctttgccaatatccacggttcttggtaagttatccaaaatcaattcattgctgtgtccgttgccattggctattgctcgaacatcgttacgcaaaatttgtacgggaatggcgtgagtgacatcggttaaaagtaatactcgactactgtttttcccgacagaaatcacttgccccacaacgcctcgttcatcaattacgggctgaccaacaaaagcaccgtcactttgtccctgatttattactacttgttggcggtaagcgtccatttctgcggtcagcacttcagctacttttttatattcatcttggcgtaaaggggaactaagtagtaaacgtaaacgttggttttctactttgagttgatcgagtagcaataagtctgcgttcttttcacgcagttgttcttttaatactcggttttcaacttgcagtttttgactgtcgataaagttgttacttacaccgtctaatacggtgcgaggggtatttgcaaaataatacaagccactgaccgctgtttcgaggacattacgcatttggatcattgcactgcttctaccatcaagtaaaatcaggctgatagagatcgcaattgcaaagaatagtcttacgccgataggtggtgctttcgcaaaaattggtttcatatttcagttatatttaatggatcttgttaaatgcaaaatggacaatagccgttgatattgtccatttttatgctaataactcaaggttgaattagttgtcgtcactaaagagatcgccaccgtgcatatcgatcatctcaagtgctttaccgccaccacgagctacacaagttaatggatcttcggcaacgataacaggcacgcccgttgcttctgaaagtaatacatcaagattttgtaataaagcaccgccacctgttaataccattccacgttcaaaaatatcggcagccaactctggtggacattgctctagaaccccttttactgcatcaacaatgcctgttaaaggttgttcaatcgcttctaacacttcttttgagcttaacacgaatgtacgaggcgcaccttctgcaagattgtgaccgtgaacttccattgtgcgaatttcatcttgattttgaatataagctgttgctatctcttttttgatacgctctgcagttgtttcaccaatcgcagaaccatagtgacggcgaacgtaagcgatgattgcttcatctaatttatcaccaccaatacgcaccgaagcagaatgaacgataccgtttaatgaaagtaccgcaacttctgttgtaccaccgccaatatcaattaccattgaaccagcagcttctgctacaggtaagcctgcaccaatcgccgcagccataggctcttcaattaaataaacttcacgagcaccagcgccaatcgccgactctttaattgccttacgctctacttgagttgcccctgctggtacacacactaacactcgaggacttggacgcataaagttattgctatgcacttgtttgataaaatgctgtaacattttttctgtcacatagaaatcagcaatcaccccatctttcatcggacgaatagctaaaatgctttttggtgtacgacctagcattgattttgcattactacctactgctgcaatactttttgatgaaccagcacgatcttgacgtaccgcaactaccgacggctcatcaagcacgataccctgcccttttacataaattaacgtgtttgcagtaccaaggtcaattgaaaggtcgtttgaaaataatcctagaaatttcttaaacataaaagggatccattaaatttagttaaaagcgaaataagcccatagacttagggcaaaaaattgggcataaatatagcaaaaaagtcctaataactccaacgaataatttatcttttgcaagttttattacgaaatcctccgcttgtaaaaatcggttaaatgattttaagatttcttcaaaataaacgtgaaaaaaatcccccaaaaagttaaataaatggtacatttgcaatgttttaattcattattattttaaccaacctacaggagtctttatgcttattggtgtaccaagagagctgttagacggtgaaactcgtgtggcagcaacgccaaaaaccgtagaacagattaagaaacttggttttgaagtcatcattgaagaaaatgctggctttaaagcaagttttgaagacgatgctttcgctcaagcaggtgcgactatcggcaacgcacaagccgtttggaatgcagacattatttttaaagtcaatgcaccaaccgatgccgaaattgcattaatcaaggaaggggcaacgcttgtgagctttatttggcctgctcaaaatcctgaattaatgcaaaaactttctgcaaagaaaatcaatgtgttagctatggacgctgtgccgcgtatttctcgtgcgcaagccctagatgctttaagttctatggcgaacattgctggttatcgtgccgttgttgaagccgctcacgaatttggtagcttctttacaggtcaaattaccgccgcaggtaaagtgccacctgcgaaagtacttgtgatcggtgcaggcgttgcaggtttagccgcaattggtgcagcaaacagccttggtgccatcgtgcgtgcgttcgactctcgtcctgaagtaaaagaacaagtacaatcaatgggtgcaagtttccttgaaattgattttaaagaggaaggtggcagcggtgatggctatgcaaaagtgatgtcggaagaatttaaccgccgtgcattagcactctatgctgaacaagcaaaagaagtggatattattattaccaccgcacttatcccaggcaaaccagccccacgcttaattaccaaagagatggttgccacaatgaaaccaggttcggtgattgtggatttagcggctgcaacgggcggtaactgcgaattaacccaagcaggtaaagtggttaccacagaaaaccaagtgaaaattatcggttataccgatttaccaggtcgtttaccaactcaatcatctcaactttacggcaccaacttagtcaatctcttgaaattactctgcaaagagaaagatggcaacatcaatatcaattttgaagatgtagtattgcgtggcgttaccgtaatccgtgatggcaaagtcacttggccggcaccaccaattcaagtatctgcacagccacaacaaaaagcggcagcaaaacctgcggagaaaaaagaagaaaaaccggcagatcctcgcattaaatatggcttattagccttagcggtgatcgcattcttatggttagcctctgttgcaccagcggcattcttatctcacttcaccgtcttcgttctctcttgcgtagtgggttactatgtagtttggaacgtcagccacgcattacatacgccattaatggcagtaaccaatgcaatttcaggtattatcattgtcggtgcgttactacaaatctcacaaggtagcttctttatcagtgcgcttgcctttattgcgattttagtggcgagtatcaacatctttggtggcttcaaagttacccaaagaatgttagcaatgtttagaaaaggttaaggagaaagagtatgtctttaggtttagtacaagcggcatatattgtcgcagccgttctctttattatgagccttgcagggctttctaaacacgaaacggcaaaagcaggttgttggtacggcattgtgggtatgaccattgcccttatcgcaaccatttttggaccacaatcacaaggaaccatttggattttaatcgcaatggcaatcggtggtgctatcggtattcgtcaagcattaaaagttgaaatgaccgaaatgcctgagcttgtggcaattcttcacagcttcgtaggtttagcggcggtattagtcggctttaacagctacggtcttgcacacgaaacagatccagtgctacaaaatatccacaatgttgaggtattccttggtatcttcatcggtgcggtcactttcacaggttcagtggttgctttcggtaaattacgaggcattatcaattcaaaagcattaatgttgccacaccgccacaaattaaaccttgcggcacttgtggtttctgcactattaatggttgccttcttaaataatcctgagaacattttccctgtattagtgatgactgcaatcgctttagctttcggttggcacttagtggcttctatcggcggtgcggatatgccagtggttgtttctatgcttaactcttattcaggttgggcagccgcagcagcaggctttatgttaagcaatgacttgctaatcgtcacaggggcattagtcggttcttcaggtgcgatcctttcttacattatgtgtaaagcaatgaaccgctcgttcatcagcgttatcgcaggcggctttggtaacgatgttcaagtcagctcagatgaagaacaaggcgaacaccgtgaaaccaccgcagaagaagtggcagaattacttaaaaatgcaagctctgtgatcatcacgccaggatacggtatggcagtggcacaagcacaatatcctgtggcagaaatcacccaaaaattacgcgaccgtggcgtagatgttcgctttggtattcacccagttgcaggacgtttaccaggccatatgaacgtattgcttgctgaagcgaaagtgccttacgatgtcgtattagaaatggacgaaatcaatgatgatttctcagatactgacgtagtcttggttatcggtgcaaacgacacagtaaacccagcggcaatggacgatccaaatagcccgattgcaggtatgccagtacttgaagtttggaaagcccaaaacgttatcgtgttcaaacgctcaatggcagtgggctatgcaggcgtacaaaacccactgttcttcaaagaaaacactcaaatgttatttggtgatgcgaaagaacgtgtggacgatattttaaaagccttataagtagcaaaaaataaccgcaacttataacaataaggtgcggttatttctacctatatttatgttcaaaaacgagcagtccttgcttctctctatgtttggcatcccctaaagtacacaagtaacatcgaaagaggcagtataatttcttggaaacctttcatattgagatgtaatgagttctgccttgcttataaacactcctatctctctaagtaataaactatatgttgcccaaaattatctgttagaatggctccaaacgacccaacttgtgggatttttgtgtagtaaattaagttatactaagctctatatcatttatttcttggactttaggatcaaccgtacctaatcaaatacattctcaattagagaatgttcgaccatttcctgtcttagggtagacatgatttttatatactaaagaataaaataatcgaatatttaacgattcttatcagattttttgttaggatagcactttaatttttctatttgttttttgagtgattacaacgaggtttttatgaacccaagacgcaaatctagactgaaagtggtgatggcagtgttaagtgggcttgccgttgctgttggtttaaccttatatgcgttaagccaaaacattgacttattctatacgccatcagagattatctatggtaaaaataatgatccagaaaccaagcctgaagttgggcaacgtattcgtgtagggggtatggtggttgatgggtcggtaaaacgtgatgataagacccttaaagtgacctttgatctcaatgatattgggcctacaattcaggtggaatatgaagggattttgcctgacttattccgtgaagggcaagggattgtggcacaaggtactttagttgagccgacaaaactgaaagcaaccgaagtgttagctaaacacgatgaaaactatatgccacctgaattaggcgatcagatgaaaaagcaacatcagccgatggggatttcagaagcagatctcaaaggaaaatcagaacgtgatgcaacgcagatctctcagccgtttggagaaaataaatgattgctgaattaggtaactatacccttgctcttgctctcgcattggcaattttattggcgatcttaccgcttgttggtgctcataaacaaaatgctagtctgatggcattggctcgtccgatgacgtgggcggtttttttagcattatcaatctcgtttggctcgcttttttatctgtttgcggtcaatgattttactgtgcagtatgtggtgaataactcaaacagtacgttgccgttagagtatcgcctttctgctgtttggggttctcacgaaggatctttgttgctttggatttggctactttctctttggagcgttgccgttgcgacattcagccgacaaatacctgaagaagccatcgctcgtgtattgggggtaatgggcttggttagcattggctttttagtttttattctgtttacgtctaacccgtttaaccgaactttccctgattttcctgttgatggtcgagagcttaatccgatgttgcaagatgttggcttaatcttccaccctccgttactgtatatgggctatgtgggcttttctgttgcctttgcttttgctattgcgtcgttgatgacaggtcgtcttgacactgcttgggcaagatggtcacgtccttggactatggcagcgtgggtatttttaacattaggtatcgtacttggctcttggtgggcatattacgagcttggctggggcggttggtggttctgggatcctgtggaaaatgcctcgttaatgccgtggattgcaggtactgcattaattcactctttagcggtcacggaaaaacgtagtactttcaaagcgtggacggtcttgctagctattcttgctttttcactctgcttactcggcacattcttagtgcgttcagggattttagtgtcggttcacgcttttgcttctgatccaactcggggcttatatattttggcttatctcgtggtggttattggcggttcgctactgctttacgcttatcaaggcagtaaaatcaagagcttagacaattccgaacgttactcacgagagtcaatgttattactcaataatgtgctattaatggcgttcttatcggtggtctttttaggcacgattttaccgttaattcataaacaaattggtttagggacaatttctatcggggcgcctttcttcgatcaaatgtttatgatcttaatggtgccttttgcatttttattggggatcggaccgcttgtaaaatggcgtcgagatcaggtttctgctatccgtaggccagttctcatttcattagccgtaatgatattgcttggctttggtttgccttatctttttgccagcaaaattactgtcagcgtggtattagggacaatgatgtccgtcattatcgtggcattgagtttatatgaactacatcaacgagcaacgcatcgtcatagtttcttgcaaggcattttgaaactttctcgttcccattggggaatggtgttggctcatttaggggttgcaatgactgtgtttggtattgcctttagccaaaattacagtatcgaaaaagatgtacgaatgaatgtaggcgacaaagttgaaattttagattacaactttaccttcaagggtattcgtgactcaaatggggcaaactatattggtggcacagcggatattgaaattcatcgaaatggtaaatatgaagccacactacacgcagaaaaacgcttttacaatgtcagtaaaatgggtatgactgaagctgcgattgactggggatttagtcgagatctctatgcagccttaggtgaacgtttagaagatggctcttggggcgtacgtttatactacaaaccgtttatccgttggatttggttcggtggtttgtttatggcgataggtggcatactttgtatgatggatagacgttatcgcttaaaacagaataattaactatgtttatcgctcttcataaggaataatcggcatggtagacaaaatagttgctaatatttattttctctaaatattagcaactatttttatttgaaaaatcttgtatagacaacatattacaccttttatttacgaagtaatttataaaactgagtaagtaagactgttggcaacaatctcggtatcactcgcatagtaaaagtgataaaacctgaaacaacattttgcatacccacttggtgttttaatttaaataaacgccattctgccttagcctgagcgataccacaacggcgaccgaccataccatttccaacacgggcataaaccaaaatttcgggtaaattcgccacttttttgcctaatgcaaccaatttaatccagagatagtaatcttcttgtaggtcttgatagccaccacattcaagcacggcacttttttggtaggcgaccgtcatatgattaaatgggcaacgtttctgcgtaaattccacaatggctttggtttctgttggcacacgacgatagctgacaatatcattaatatctgagccaaattcagcaatttgtccgccaaaaataatggtatcgggattttgttcaataaacgcaatctgtttttcaaaacgttctggaatacaaatatcgtccgtatccatacggaatacccattcatttatgcagtggattaagccatgattgagtgcttttcctaacccttgattttgctcaagtctaacgatattaagcggtaagatctccgcaaaattttgcataacttgttctaattcgggggtaatagctccgtcaaatacaacaacaatttcgtccgcttgaaccgtttgattttttaaactttcaaagcattcggttaaatattctggtttttccttaaaatataaggacattaatacggaaaatttcattaaataaaccttttcatattgattgcaagttttggtgaaataaatatgagagtagcaatcaccaaatgtttaatatttttactttgtaagaacatctgccaataataacaagccgctttacgagataaattcattatatgtgggtaagaaagcatatataatgcattaaaagcaaagtttttttgttgaatatctgtttttacatatttttgtttaatagtttcaatcgctaattcagtattttgtgtatttgtcgatacacttgctcgtttagtatggaaagtacaggttgttagggcttcagaaacatattttggtttaaactggttatgagaaatcactttcaaaataaaatcatagtcttctaaagattttaaatccgttgataatccattgactgcaaagaaaaatgattttttaatcgcaatcataggcattccacctactttatttgccagtaaaatattctctaaagtgaccgcttgttcattttcataggggcgagtgatataactaaacccttcatttaccatcacacattcagcagggtgataaataaaattaatcgtcgggttttcattaattgtttttgccagtatttcacattttggatgagcaaaacgatcatcatcatctaaaaagagtagccactcgttttcagcaaatcttgctcctacattacgactttctgctgctcctaaattctgttcattcctaatcacattgacaggaaatgggtagagatgtttaatttctactggctcaacagagtgatcatcgacaataatcacttcaaaattatattccgtttgatattccaaacttgttaataatgcaggaatttcattttttcgattataagaaggaataataatactaaacattttctgtcttgttatttaaaaatagaattttatttttaccttcattgccaaataaagataaaaacattaataacactaacataatgccagggaaagcataggcatcggcttttacatttaaaatggagagaataagtaaggtagataagataaaaatccaactaccgtcaaaccaatttattgccacttttcgtacgaagtaacacataaataagaagcaaacagagagataaataaatccgccatataatgtttggcgtaaaaaaccagagtctgtttttccgtagtagccaccttgaggataaaaataacgtccgtcaccaattaaaatctgttttaattcagggatataaagatgattttgaacgagattatcgtagatgaactaactaaaccatagccgtgaataacattgattaaaggctctaaagcgtgttgtacatatttattttctgcaacattaaaggctaaaaataaacagatagctccaaagagcaaaatggctggtatatatttccatctaaaatagacaagaaaactaattgcagaaataaataaaaaagtacgtcctgaaattaaaccaatacataataataagaagacaaatatcggactgatattattatattttgcattataagcaagtaaaaaatgcaataagaaagcatagaataaactaagctggaagaatacagtagaagttaaattatataaacggtattcttgttctgaaccatagaatttagggaaaaccgcattcgttgaaatacctaaatcaatcataaagggaatacctgccagtgcggtaaaacccactactgcttgaacaataataccgatttttaaatccctaaccatcatttcttttgcattagttttttgataatagcagagattataaatggcaacgccacaggtaaataaaattaagcctttaatatacattcctacggcataaaattctttagtgccgtgagataacatcggaataaccgctacaataattaggataaaaattgcgaaaaaactatccagtggtaatgtaattccttgtaagcgttgtttacggtagatttggtaaagcaaatataacatcgctattccaccacagaaaaatgccattcggaaaaaatggaataaccacggatcgtaaatataaaatagattaatgaatgctgacattttattttcctaaattacgttttattgccagtaattttttcagtgggtattttgctaattttgccccaaagctgtgtgaaatagatccacgaatactttctaaattactatttaattttgggttttcaatcaccattaatggacgaaccactttaatatctaaattaaaggtgttgccaaacaaaataaaatcatctgctagccaaaatggtaggttttgttctatctgttttaaaaaagtgcgagtcgctgattttttaattagatatgctactgttcctgcaaaataatttttataaggataaacaaccgcaaaaggacaagcggtaatttttggctgtaaaaatgcaaaggttgttggataattaatttctaattcaacatcattaaatgtcgcaattttagattgccccactaaaataatatctgcggacggctgtttatttaaaatacggttcaaatttgcctgaaaatcctgattaaacagtgcatcatcttcgcaaactaaactatattcatcatcaccaatcgtttcatcatcacaaatttgctgataaacaccaagatggcttaatgtacaaccaacttcgcctttcgtcactttacgagcgtaatgttgctcaaaatgagcgagattaaaacgtgaagataaactttgttcatcttcattcatcgtattaaaggcagaaaaaacgctaaaatcagcggtatcttgctgtgaaaaaaacagttcccgtctatgactatctttatctaaagagattaaatattttttcattttattatcgaatatcaataatggttacgcctaatttttcaaagagttggtaaacttgaataaagtctggattttcgacattaattcttaatgcaaccacatcaatatttgggattttgtcttttatatttaataccgcactactaaaataagtatatatacgacatcttttatgtttaaattcctgagctaaatagtcttctaaaattagtggcgtttcaatatattttacttgatttaatttatattgttctcttgggtgtggtaaataagcgtgaatatcaaaccacttgatgaccttttccgctaattcaatatttttctgtttatctaaataaacgggctgacctaataaaatatttatggtttcaccttctgctacatcactttctgtttgcggaaagagttccagatattcagtattttgaataatgttcggcaaatcagcataaatcgtaaaatgttttttggataacgcctttaattttgccacgctgtatttattgcagagtaacgtattaataaaacggcgaatacgagtttttggctcatcgacataatacacactatggcttacaatatttgctgtgccatcatcaaatgtataaaactcattaaattgaatactgcttagaataaactgaatttgaatgtcattaatgcttgcgacaaatactttatcaaacttcttaaatgcaaatttaagacgcaaactaataatctcttttaatagattaaaacgatcaatatgttgatccatctgaaagaaagtatcacattttttcgctaaacgttgcacataatattcaaatttctgattttttgccgagcagagcatcacaccataaaatttttcatttggataaagattaataattcgctctgcaatcaaaacctgcaaaggcgtatagcaaatgatcaaattcatacggttttccccactttagatgtcataaaataaagtatcaggatcatcacagctgaaccaataatacttgcataaggtacaaattcaatagaagtaaaggttaatccgattaaactcaaaatatatattaccgttgaagccactgaacagattgagattaatttattcttactgtgataaaacaggtaattcactaaaataaaataaggaataacaagcgcggtcgaaagtaagaataaaataatatagtattttgttccaacaaattgaacccctaataaccaaactataaattgctcaggaataacccacataattaatgaaggtaacggaacaatggctaaggaataaaatgcccatttttgcgtttgttttaaattaattcgaccttgttttaatccatcaaaaaaatagggagtgagtgctttatttactgcttgtaaaataatcatcaatatcgcagcaatttgagcccccatcgcatataaacctaaatcaacttgattaaattgatgataaataaatacacgatctaactgcccttttaagaaaaaactcacattatgcaaaattaatggcgtaccaaaagcaagcacataaaagagtgctgatttatattgcttccattgatattttttacttaccgtctttttgctataaactagatatgccaataaaaataccagtacattgcctaataaaatcccaagtaaccttttttcgaccaattctgtttgataaagttcgagaagtaataccgtaaaaacaacagtgcctaagctagaagcaaattgcaaaatggcataggaaatcgcctgtttttgacactgtcgaatgctcagctgaacacctaataaggcttgaaaaatagcagacaaggcaacataggtaagaatttctgattgtaaaatccagcaacccagtaaaattaagctacctatcgcaagggtataagcatagccagaagtcacgactaagttaagggagcgtttaccataaacatagaagtaacgggttaccgccccttcttgacttaaaccgacaataataaagaaaagcacaagataagtttggtaatatgcaagttccccaaacccttctacgcctaattttcgagataaatagggcaatagcaaaaatggcattgcccgtgaagtcagttcaccgattaaataaactgcactgtctttgatggctctcattgcatctctttctcaatcaagctatccgccagttgcaaatctaatgtggtatcaatatcgactgagcgataggttggcattaaatagaaacgcacaggtggaataaagaagtatttttcttgaagtaggctggcgacatcgttgatataaatcgccccattcgcacggtatgcttttggtaattgctgacgtggtgcttcaaaatctttgatttcattcatcgggagaatatcatctccatttaaaacaaatgatttatacgggtggtgttcacattcacaagcggataccacagacttgctttttccacctaaaaagatttccatcgcattgcgaatatctaacgcattgcgtaatgggctagtaggttggaaatgagcgacaatgccttcacggatatttaaggtttctaaacagtgcaaaataacatcaatagaacgagtatcactttgagccaattcagcagggcgaagtagtggtgttgcaccatatttttcaccttcctgtaaaatacgttcgccgtctgaagtgacaacgattaagtcaaacattccagactcttttgctgctagaactgcacggcctacgagcgaaattccgccgactaattgtaagtttttatctttaatccctttcgagcctgctctggctggaataattgcaatttttttcataaatctaaccgctagtaatatggttaataagacttgccattttaattttaaagagcgagttaaacaatagacaacggaaaaggaatgaggaataataaatctcttttacttacttgacaaaattgcctactcattatgtttgctatcacaaaatttattactgcggtcattcttccaccatttaacattctgattttatggttgttttctttaatttgtttccgcttaaaatggaaaaaattaggttatctctcaacctttttaggcatagcaattctctatattttcagtattccctatacttcgcaaaaattgcacgattctttggtaactgaagataatctgagcattgaagattataaatcagctcaagctatcgttttacttagtggtggcttgcgtgatagtaaagagttatttggcaaattagcgatcagcgaaatagcattagagcgggtacgttatgctgcttttttacaaaaagaaacgggcttacctttattgattacgggaagtagcccaaaagggacttcagaagctgccgtcatgaaaaaagagctcgaacaatttttccatattccaacacaatggttggaagaaaaagccaaaacgacggctgaaaatgcgaagttttctaaacctattttagaaaaagaaggtattaataagattgtgctagtgacaaaccagtggcatatgcaacgagcaagaatgctatttgagcgagaaggttttaagatattacctgcaagtgttggagcaggaaaaatgcctgaaacctatggattaaatgtattttactttatcccacaatcaggagcattacatagcaatatgcacgccctgaaagaatggattggatattggaaagagaaataacggacattattaggttaatacatttagtagatcagccctagtgtaaaaacaaatatcactaaaaattcaaatagaccgacttgtttaattttccagtttctttttggcacaataaccgctctaattaacccaatgaaataggcaaagctaatgccataatcgcctaaggcgagataaacaaagataaatatacaatgaagtcctatactgaacttacagtaaagaggatttttccgctctcgagcaacgctttttacataaattgttgtcccaataaaaaataacgtagggtggagtaaaatctcaaaattatattggtttgttgctaaatagaaacttgccattccaattatgccgaaggttaaaatacctgcaatatcattgattaagtttcgttcatctttttgttttgcatagtaaatttggaaccctgcaagcggcaggattgggattataaattgcaaaatagaaaaatgacttaagagtacgggaaatataaatatgccgctaaatacggcataaataatcatccagcgtttatatttttcattttgttttttgctaacgacggagaaaaaaggataggaaaagagataagtaaaaaaccagctaagcccaagccaaaaatgattcattacaaaatggctagcagaaataccataaataaatggtacaaatgccatcactaacgctccgtactgattagaaataatcggcttttctttaaatatcatgcttatttctctactattttgtcttggttcccatatccagttttaaatttgatactctactatattgatttactttacttgcagcttcttccctacaaagattttattttgttttaaaccatttagctggctcaatttttcaggtgttgttttatacatgcgagcaatggaataaagtgtttcatctttctgaacaacatgatatttcgcattgagatcaaccgttttttctgacgctttagacgattgtttttgcttagtttccgtcgttatttttgctttctctttagttttttccttaggcgaagtcaccgctgctttagcttttttagcttccttagagcgattttctacctttttttcagttttcgatttcttggttgatttttcatcattaactgctatttgattttgctgttttggtaatctatttttatatgcaattaacccttgataaatcgcctttgcaatctgacggcgatacgcttttgtggctaaacgttgttcttccgttgcattagataaaaagcccgtttccactagaattgaaggaatatcaggggaacgtaatacgctaaggctggcgtgttgtggcgaactttttgctaattgcgtaacatttctcagtttgtctaagactgttttacctaactcatagcctgaacgttgtgcgtgagaaaactgcagatcaagcactgtctggttcaagtaacgttcattattatttgccaaaaccgaacctgccccacctaataattccgattgcttttcgtgatcttccaaccattttcctaattcatcatttgcacgacgattagataaaacccaaaccgaagcccctttcagattatctgaactaggtgaagaatcagcgtggattgacactagataatgtgccttatttttacgagcaatttcagttcgattaggtagttggataaaatagtcaccattgcgtgtcattactgccttgaaattaggatctgcatctaacaacgcctttagttctctggcaatcgctaaagtcacctctttttctttgacccctaaatttttaccgatagcccctggatctttgcccccgtgtccagcatcaatggcaatggttaattttgcttgtgcggaaagagcaagaaataaactcattaccgtaaagcaaacataatgtcgtaatttctgcatagtattaccctaagcggtctgatattctaaataattttccaaaatctgttttgctaagtcgttttgaggcataagagccagatttcgccctgtttctgcatagtcaatttgaataataaagtccgcagatgggatcattccttcccctcgacttgcccattctagtaagcaaaccgtttgtggacggaagtagtccctaattcccataaattctaactcttcaggatcactcaaacgatataaatcaaaatgatataaagcataagggggaagctgatactcttccactaaagtataagttggactttttacattcccattatgcccaaaagcacgaacaatgctccgagtgagcgtcgtttttccagcccctaattctccattcagataaatcacaatcgctttttcactatgattttctaaatagcgttgaagttgttgggcaaaacgctgaccaaaattgagcatttcttcttcagttgcaaaataaaatgattgcattattgttaatctaaattaataaaatggtgacgataaaacttcagctcttcgatagactctttaatatcatctaaagctaagtggctgtttttcttactaaattgtttaagcatttcaggcttccaacggctcgcaagctcttttaatgtactcacatctaaatggcgatagtggaagtagtccgccaaatctggcatatatttataaaggaaacgcttatcttgtgcaatactgttaccacaaatcggcgaagcccctttcggcacccatttcttcaggaaatctaatgtctgtaattcggcagcacgttcagttaatttactctgcttcacacgctcaaccaacccatttgcagtatgggttttcacacaccattcgctcattttatttaataattcatcgggttgatgtacggcaagcacagggccttcagccaaaatattcagatctttatcggtgataatggtagcaatctcaataattcgctctttttcaggatcaagccctgtcatttcgagatcgatccaaattaaattttgtttgtcttgttggctcatctttttcaattaattatctaaaattccacaggatattatttattgtagcatttcatgcaccactttcataaacccatcagcagtagcataaacttcttctttgccttgagcttttaaaatcatatcggaaagctcacggaatgcggaatgtccgcctttacgcgttaagactaaatctgcctgatttttaacataatcaaaagcatcgcccacggcaactgctaatccacagacttcaaatgcgggtaagtccagtgtatcgtcgcctaaaaatgcagtttcttcggctgaaacccccgcttgttgcattaactcaaaacaggcatcacgcttagacattttgccaagttggaaaaggggaatgcctaaatctttgatgcgacggcgtaaaatcggggtgtcaccgcccgatagcactgcaacttgaatgccgcaagcaagaagcattttgatccctaaaccgtctttcacattgaagtattttaatgcttcgccattttcggtgtaataaaggctaccatcagtgagtacaccgtccacatcggtaatcacaagtttaatttttgttagtctttgcataagtatccttgatttcagttaagtggagttttatgatcttgcccattatagccttttggagtagccaatgtcgatttctcaaaatttagcgacaatttctcaacaaattcaacaatgttgtcagcaagctaatcgccctgaacagagtgttaaactgcttgcggtgagcaaaactaaacccatttcagccattgccgaagccattgaagcaggacaacgtgctttcggcgaaaattatgtgcaagaaggtattgaaaaaattcaacattttgcggagaacgacacattagaatggcactttatcggtttattacaatcgaataaaacgcgtgtagtggcggagcattttgactgggtacaaacgatagataggctcaaaattgcacaacgtttaagcgagcaacgccctaaacatctgcctgaactgaatgttttaattcaaattaatatcagtgatgaagcatctaaatcgggtatttctgcgaaagaaatgctagaattagccactcaaattagccaactgccacgtttgaaattgcgtggtttaatggcaattccgaagcctgaaagtgagcctgagcaacagaaaatcgccttagctcaaatgaacgaactgtttcttcaattacaatctcaatttgaagggattgatacgctatcaatgggaatgtctgatgatatgccaagtgcaattgaatgcggttcgacaatggtgcgtattggtacggcgatttttggggcaagatcttaaatttgattgcacttaaagacaaatattcttatcctttccacatttgaaagttctaagggagaagctatgcgacctaaagcaaaatttagaaaagattaccgtcagcctgattttactattcatcaaatttatcttgatgttcagcttgatcctgagcagacgattgtcacatcgacgttgtcgatcatgcgtaagaatgcagaagcgactacgttacgtttagatgggcatagctttgaatttttatcgattaaatttaatggcgagccattcaaagaatatcaaaaagatgatgaggctttgactttaaatttagccgatttccctgcggatcaattcgagctggaaattcagacaaaactcaatccatcaacgaatacgtcactacaagggttatatcaatcaggcgaagggatctgcacgcaatgtgaagcggaaggtttccgtcagattacttatatgcttgatcgccctgatgtgcttgcaaaatatcgcaccaaaatcaccgcttgtaaaagtaaatatccatacctgctttctaacggcaaccgtattgctcaaggggagctggacgatggtcgtcactgggtggagtgggaagatccgttctttaaaccaagctatttatttgccttagtcgcaggggattttgacctgttacaagataagtttatcacgatgagcggacgtgaagttgcccttgaaatctatgtggataaaggaaatcttgaccgtgccacttgggcaatggagagtttaaaacgttcgatgaaatgggacgaagagcgttttgggctggagtacgatttagacatttatatgatcgtggcggtcgatttctttaatatgggggcaatggaaaataaggggttaaacatttttaactcgaaatttgtgctggctaatccgcaaactgcaacggacgatgattatttgaatgttgaagcggtgattgctcacgaatatttccataactggacgggcaaccgtattacttgccgtgactggttccaactcagtttaaaagaaggtttgaccgttttccgtgatcaagaatttacttcagatttatggtcaagatcggcaaaacggattgaagatgtgcgattgttgcgtgcggtgcaatttgccgaagatgcaagcccgatggctcaccctattcgccctgaaaaagtgattgaaatgaataatttctatacggttactgtctatgaaaaaggggctgaagttattcgtatgatccacaccttactcggcgaagagcgtttccaaaaaggaatgaaactctatgtggcagaaaatgatggcacggcggcaacctgtgaagattttgtgtctgcaatggaacgtgcttcgggagttgatttagatctgttccgccgttggtatagtcaatcgggtacgcctgaattaacgatttctgatgagtatgatgaaaaacgtcatacttaccgcttgcacgtttctcaaaacacaccaccaaccgctgatcagctagagaaagtgaatttacacattccgttgaaagtagcgttatatggtcaagatggtaagaaaatcaatttacaacacgaattattaactgtcagtgatgtgttagatgtggtccacgaacatcaaacctttgagttccacaatgtgcaacaacgtccagtgcctgccttgttatgtgatttctcagcccctgtgcgtttagattatgactattcaacagaacagcttttaacgctcttgaagtttgctgagaatgatttcgtgcgctgggacgtggcacaaatgttgtttaacaatgagctgcgtgaaaatctaagtcgctaccaacagggcgaagcaatggcattctcacaaggtctgttagaagcgctcacctttgtgatcgacaatgcaaataaagacccagaacttgccgctttaaccttaaccttgccaaaagaaacggaatttgcggagttgtttaaagtgatcgatcctgcaggtattgcggctgttcgtcaatttatgcaacaagcgattgctgatgaattaaaagatcacttcttagtcgtttacaaccaaaataaattaacggaataccgtgtggttgccgaggatttggcaaaacgtgcattacgcaatgtttgcttgtcttaccttgcctttactgaagtagggaataccttggtgcacaaacattatcatcaagcaaataatatgacggacactttggcagcactcacggcttcgaccaaagcacaacttgcttgcagagatcagcttcttgccgattttgaacaaaaatggcaacacgatggcttagtgatggataaatggtttgctttacaggcgacacgtcctgatgaaaatgtgcttgaaattgtgcaaaatctattaacgcacccaagttttaactttaaaaatccaaaccgtgtacgttcactcgttggagcatttgcaagtcaaaacccaagtgcgttccacgccattgacggttcaggttatcgtttcttagtcgatatgttgattaagatgaacgaaagtaatccgcaagtggcggcacgcttaattgagccgttaattaaactttctcgctatgacactcaacgtcaaaccttgatgcgtcgcggcttagagcgtttgaaaggcttggataatcttgctcgtgatctgtttgaaaaaattgaaaaggcgttgcagtaatgatctggcataaagcattattttcttttcacggaaggttaaaccgtaaaggcttttggatcggctttgggattaattttgcatttttgtttatttttgcaaattttatcttaaatccgaccgctttcagctggattagcgttctacccttgaccctttcactttacagtttatctgcagtgatcgttaaacgcctacacgaccgtaatcgttcggcgaaagccttgtttatggttgcggtgccgatattgtgttatctcagttcattgggagcgcaaggaacaatggcatttgtgctaggcattatgatgccgatgtttatcggaacgattttagtgatggaatggggtgtttttgcaggaaatcctgaagctaatcaatatggtgagaaaggattgagtgtgagatttaaataattgtagggtgggtcttgacccaccgtttcgttgtaatatcttgaatttattggtgggttaaaacccaccctacaaaactgttttttaaatctcccccagcccctctttttcaaagaggggcgtttacaaattttaataacaaacaaatacaaaatgaccgaaataaaacttaactaccacaaaacccattttttaacctctgcacctgatattcaccatttaccagaagacagtggcgtggaaattgcctttgcagggcgttcaaatgcagggaaatcgacggcattaaatgccttaactaatcaaaaaaacttggctcgtacctctaaaatcccagggcgtacgcagttaattaacttatttgaagtagaaccaaattgtaaattagtcgatttaccaggctatggttatgcggcggtgcctgagcagatgaaacttcagtggcaacgttctttaggtgaatacttgcagaaacgtgaatgtttacggggcgtagtgattttaatggatattcgccacccattgaaagatctcgatcagcagatgatcgaatgggcagtgtctgcggaattacctgtgttattgctacttaccaaagcggataaacttagccaaagtgcgagaagcaaaaccgttaaaatggtgcgtgaagcaattttaccgtttcaaggcgatgtgcaagttgaagcctattctgcattaaatcgtattggtattgataaacttgcgactaaattagatagttggttcgccgaaatttttacacaaacccaagagggctaatcttatgtacaacttaaccgaattacgccaagaaaccgatgaaatcatcaaatctttattagacgatggcagcgatcctgaagccctttatattatcgaacaccacgttgctcatcacgatttcgataaactcgaaaaattagtggtagatgcttataagttgggctatgagatttctgaagcggaagaagtggaagaagaaaatggcgatcttgtgtttgtgtgcgatattgtcagcgaaattaaattagatgcggaacttattaccgctcaacaaaaagagctactgccgttaatcgaaaaatcgggtgcggtctacgaaggctggggaacttattttgaagatccgaacagtgatgaagatgaatatggtgatgacgacgaatttttcgatgacgaagatgatgattttgatgatgaaagacgttaaccattagcagaattatgaaaataaatgataaccctatgtagaatatttaccatgtaagaatcaagtaataaggaggagcaatgctaacaaattggtcagaaggttatgttaatgatattaattatacgacaggttattacgatggattaaatagccaccaattaatttgtccattcttaatagcaaatttacagccgccaaaagtcattaatgcgtgtgagttaggttttgggtttggtgtatcgcttaatattcatgcagtagcaggaacagtaaaatggtacgggactgattttaatccttctcatgcgttctttgctcaacaattagcaaaccaaggcaatccagataaagtcgttattgcagatcaatcttttgccgaattttgtcatcgagatgacttacctgattttgattttattgctctacatggtatttggtcttggatttcaccacaaaatagagaaactatcgttgattttattcaacgtaaattaaaagtaggtggtgtagtctatattagctataacacattaccaggatgggcaggaaaatcaccaattagatatttattaaatcaatactatagtaaattatctgctactctagaatcaaaagatcaagcgattaaatcagcattagaacatacaaagaatatgctttcagtgagtaatagtctcctttctctctcaccttatttgttggaacaagttgaacagatcaaagaacaaaattctaattacgtcattcatgaatttactaatcagaattggtatccaatgtatttttcagaaattgaatcctgcttgaaacaagctaaattaagttacgcatgctccgtttcttatttagatgattttgatgaggttttatttgatgaagagcaacaaaaattattatctagcattcaagatccttctttatttcaaacagcaaaagactttattttaaataaacaattccgccgtgattattgggttaaaggaaaatctcaacttactaatcaacaaggagagaaagaatggaagaaattaaatatattacttgtttcatctacaacaaaaatttcgaccacgattaaaaactaccgacaaacggaatttaaagaagaattattaaaacctattattgaaaaattatctgattataagattcactcgttagaatctttgtgtgaagccttaaaaggggatatgcctccaaatgcattatttagaataattgccctattagtagctcgaaaagaagttgtcattactcaatcggctgaaacaatagaagcagctacaaattcctgccagaaatttaaccgagctatattggataatccttttgcttttaataacgttaactatctggcaagtcctgtgtcaggtggtgggatttattattctaatattgaattactctttttatctgcatatgtacagaaaattccagagaaacagtgggaaaaatatgtacgtactattttaacagcacataatcaactattacgtaaagatgataatattctatcttctgaagaagagatacttggagaaatatctcgtctgaagaaagaatttttagatgatagatttgaaattacaaaaagtttaaaggtggtctagcccctttttcacccaatattgatacggcttagtgtccgtttgactttttaatagctgatgatccataaattgacaaaaactcggaatatcacgagtagttgcagggtcgtcagcaataattagcaacacttcaccgtctgccatattgcgaatggttttacgagtaagcattacgggttcagggcaacgtagccctagggtatctaaagtgtggttaatggttagttcggtcatatttattatcttatctatgtaaaaatttactctctcccgtttacgggagagaggatgattatataaaggatctttatgcaacatatcttttcacaacatatcgcacgcattcaacaaattgtacagcacgccttagagctggcgcgtcttgacgggctttggatttatgcagggcaggcaaaataccattttttagacgaccaaacatcgccatttaaaatcaatccgcattttaattatatattccctgatcccactgcagaacaaagttggctttttttagacggtaaaaataaaccgaaactctatttttatgcaccgcaagattattggcattgtatgccaaatccgccgacatcggcattttttgctgatgagtttgaatggcaaatgctcacggatagccaacaaattcaacaatatatccttaatccgacccattgtgcctttattggggaacaaacggagcttgccaaatcgctaggttttgagcatatcaatccacagaaaatgctaaatgtactgcattttgagcgttcgatcaaaagcgaatttgaaattgagtgcatatatcaagctcaactcaccgctttaacaggacatcaagtggcaaaagaggctttctttgccggtaaaagtgagtttgaaattaatctagcctatcttcaagcgaccaagcaatcggataacaatgtgccttatggcaatattgttgccattaatcagcatagtgcgattttacattacacaaaattggatttcacgccaccttgcgaacgccacagttttttacttgacgctggcacaagctatcttggttatgcctccgatcttactcgaacttatgcttttgagccacaaagtgaatttgccacaatggttgctcaaatggaacagtttaaactggatactattgctgatatgcaagtggggattaattatctaagttaccatacccaaatgcaccgttggatctcgcaaatgcttcaccagtttgagtttgtgaaattacctgccgatcaaatttttgaagagggtattagccgtaccttcttcccacacggtttagggcatcagcttggtttgcaagtccacgatgttgcaggtttccaacaaaatcaccgtggcacacgcaaagctccgcctgagatttatccaagtttgcgttgcactcgtgatttagccgaaggtatggtgcttaccattgaacctgggttctattttattgagatgttgctaaatcaatggaaaaaccacccgcttgctcgtttctttaactggcagaaaatcgacgaatttaaacgctacggcggtattcggacggaagataacattgtgatgagagcgacgggggcagaaaacttaacggcaaaagctgaaagtatcagtagcagataagtaattattacagatcccatttagcttaaaatatctaaatgggaagttggtgtactcataaataatatttctaatctaaagaaaatagatctaataatgtggcaaagctttgcgatttcactatattgtgaaactcttcaatgtaaactttatctagatctgtttccctgattgctgcgtataaattgctatataagccattagaagtgatttttcttgcaacaacatagcctttttctaaatatggttttacagcccaataaggtaaggctgcaatacctcttttactggcaacaagctgaatgattgcgatagttaattcactagtgcgtcttgttgggtttattcctactggttgtaagatttttttcaataaatctaacatattgtcgggaacaggataatgaattagtgtttcgtgacgaaaatcttcagcttcccaaatttctttttgagccaaagggtgatctttggcacaaatagcaaccatttcataagaaaataaaggtttataaataataccaatggactcttctatttctgatacaacagcccagtctgctcggtgagcaagcaatagaccaacagtatcagtatgaaaaccagacacaatatctaattctatccccccccaattttgtctaaaaatatccattgctggcattaaccaatcaaaacaagtgtggcattcaacagcaatccgtaattctccaacttctccttgtttaattcgggttatatctgattcagcttctattattttaggtaaaatttcataagcgagctgtactaaacgttctccagctggagtaaaatggattggctgagttttacgttcaaatagagttagatcatattgatcttctaacaatttaatttgatgagataatgctgattgtgttaaatgaatacatttggcggcagctgaaacactgccgctttcttttaaagcaataatagttcgtaaatgacgaagctctaagaaaattggtttcattagtctgaattttgaatgtaacaactacaattgacctagaatagcatgtatttactatattagaaaatcgttttcctaatcagcattactttattttttattagcatgctgggttaaatacatagtttctattatctatatcattttataaatggcaaatagccttctatttaaatattacttaaaatatgaaaaaaactatttacttccataaattagcaatattactttctctatttttttcaaatgaaccgattgttgctaaacatatagcacagaaaacatgtatagttgtaggtatttatgatggcgatactttaacctgcttgcacaagcggacacaacttaaagtacgcctgcaatatattgatgccccagaatttgcccagccttttggtaataaggcgaagcaatcgttaactcaactggcatttaaaaaagaggttgaacttgagattacggggtatgataaatatcaacggctgttggcagtggtttatgatcagaggggtgaaaatcttaacttaattcaggtgcaacgaggaatggcgtgggcgtatcgccaaacacaacctgtgtatctgcaagctcaacaacttgctcaacagcaaagaataggtttatggcaagataaaaatccgatcaatcctgcggactggcgtgcaagtaagcggtcagatgaacattcattttggcaaggtttttcgcctaaggcaccgcttgccactatagattgtaatgtgaggaaaagttgtaacgatcttcccgattatgacacggcgaaacgctactttaaacaatgccgttggcgagagctagacggcaataatgatggtatcccttgtaataaactttatagaaaggctcagcgacaatgattaatcatacttttcgttcccatttccctttttttcaagatagtcccgatgcggtatatttagacactgccgcaacaacactcaaaccgaaagtgttgatagacgcaacgctcaatttttatcgttcatctggttcggttcaccgtagtcaatatgattttcctcaaacgcaacgttatgaattagcaagggatttagtggcaaaacgtttcaatgttgcaacacgagatgcggttatctggacaagtggcacaacccattcacttaatttagtcgcaaatggtttagctgacagtattgaagctggtgatgaaattgtgatttctgtggcagaacatcacgctaattttattccgtggcaacaacttgctgagcgtaaacaagctagattgattgtgctaccgcttaatagcaactaccaaattgcccctgaaacgctacaaacagccttatcagaacgcactaaaatcgttgcgtttaatttggtgtcaaatgtaacaggggttaggcagcctgcagagcaattgataccgcttattcgtcagcaatgttcagccaaaattgtgcttgatgttgcacaagcggtctgttgtgaacaaattgatgtacaagcacttgatgccgatttctatgcgttctctgcacataagatgtacggaccaactggggttggcgtattaacagggaaattgagtagccttgagcaactccgccctcttttatttggcggaaaaatgttacaagagattactgagcaaaagctcacgatggcaacattgccttatcgtttagaagcaggtacaccaaatatcgcaggaattatcgcttttggtgaggtgctggagtggttggaaaaatgggatttttcagctttaaactcaccgctttatcagcttgcgaaagaagctcgccagcggttagcgacttatcccaatatccgtattttagcggaagggtgtttaagcccaacgattagctttgtctttcatcatcaacatcacgcagatattgcggcgattttagccgagcagcagatcgctttgcgtagtggcgaacattgcgccaaaccctacttacgttatttagcgcaaaatggcaccttgagaatatctcttgctcattacaatgttcaagcggatcttgaccgcttttttaccgcattagattttgctctcgacattttagaaaattaatatcaacttagatcaaaaaatcgtaaatttcccgattttctgctagaacgaaagggcgttatagggtaatctttgcaagttttttgatttattttttaaaattaaatttataggtattgatatggtaaaaaaaattgcagtattaaccagtggcggtgatgctcctggtatgaatgcagcgatccgtggtgttgtgcgtgcgggtttaagtgaaggtttagaagtatatggtattcaagacggttattacggtttatatcacgaccgtgttatcaaacttgaacgccgttcagtgtctgaagtgatcaaccgtggcggtacattcttaggttctgcacgtttccctgaatttaaaaatccagaagtgcgtgcaaaatgtgtagaaaccttgaaaaaatatgaaattgatgcgttagtagttatcggcggtgacggctcttatatgggggcaaaactattgaccgaagaacacggcattgcgtgtatcggtctacctggcactattgataatgacgttgcaggcacggattacactatcggtttccaaacagcacttgaaaccgcattagaagcaattgaccgcttgcgtgatacttcaacttctcaccaacgcatttctatcgttgaaattatggggcgccactgtggtgatttaaccttaagtgcggcattagcaggcggttgtgaatacattatcattccagaaaaaggttttgataaagagtcactaatacgcaacatcgaagatggtttcaataaaggaaaacgtcacgcaattattgcgattacagaattaatgacagatgtacaccaattagcgagagagattgaagaacgctttggccacgaaacccgtgctgctgtgttaggccatacccaacgtggtggtgcgccttgtgcatttgaccgtattttagcttctcgtatgggcgtttatgcagtagaactcttgatgcaaggctacggtggtcgttgtgtgggtattcaaaatgaaaaattagttcaccacgatattattgatgcaatcgccaatatgcgtcgtccgtttaaagaagaaatctttaatacctctagaaaattattctaataaaaagtggcgctaagccacttttttattatccgtatctttaaccaaatcactgaatgagtcggtgttctattcggctttatcccaaaatactaattgctttatttactcataggtaatttgtcaattttgtgctttaaggaaaggcaatagcaataatgcgatgccagaggctgcacaagcaatcacgacaaaaaatccggaccagtggtgtgattccatcactaatgctaaaggataaccagctatggcagcacctaaatatgcaaataatcccacaaaccctgttgctgaagctggagtttttttatgggaacattcagcagctgccataccaataagcatttgaggaccaaatacgaaaaaacctactgaaaagaaaattcctgcttgtaatatgaaattttcttttggcataagccacattgcaataatggagaaaaaaataccaatagcaaataacaatgccattggaccacgattgctagcgaataatttatctgatccccaaccagcaactagagatcctataaatcctcctacttcaaagagtgaaagtgcactattagcagaaacaagatcatagtgatatttttcagttaaatagatatttccccaatcgttaatggcagttctaaccacataaacaagagcataacttaatgctaatagccaaatgtatttattaaaaaaaacatattgatgtaagatcttattccatgtgagatatttaccctctttctcttgagcaagctctaagttatcattgcgccattttcctatgctaggtaatcccatggtttctggagtattctgtaatcgaaaaaataggaatatactgattaatattgctaagcccccagcggcgataaatccatatctccaactataatgtaaggtgagataaccaataattaatgggatcatcgctccaccaacattgtgcgcagtattccaaatagaccaccataagcctctttcatttcttgaataccaagttgttagtaacttagaacaagagggccatccccatccttgaaaccaagcattaataacccacaatatagtaaacatgagaacagagctagataggccaaataatatatttgtgattcctgtaagaaataatccataagccataaaatgtttaggattttctttatctaggtaaacacctgaaataaattttgaaataccataggttatgtagaataatgttgagattatccctatattatttttatcaatgcctaaatcagtaattagagtaggaacgacataattaaagcttttccgagtcaaatagaagccagcataaccaatatacattcctatcataatatgtagtcgccagtagtgataaattttatgactttgattttccattatttttatacgtaaggtaaattaactttaagtgttgttccatgttgaattggatttttttcaataggaatagagataatttcaaatgtaccacataaaatattcactctctcttgcattccacgaattccaaatcctgttaatatctgatatgtatcaaatccaaccccgttatctgtaataataatatgtatattattttttatttcaatttctatttttaccttatttgctttagcatattttataatattattcaaactttcttgacataatctatatatagtaatttcaagaatatgttctaattttaaattttgatcatttttccatattaattcagtatcaatttgattatcttgaaaatttagttcaataaatagattctcaatagcttggggtaaatctaaatcatcaagtagacgaggtcgaattcgatttagtagtacttttgttgtatcataaatattaagagataattgctctattgtggttgatattttttcataatcaggtgcaatcctttttaaaatatttgcttgagttctaatggctgtaatattttgcccgacctcatcgtgtaattctctagagatttcttgacgaatagtttcttcagtattaatcagctgccgagtgagtaatctatttttatttaattctattgataaactctggttcaagttacgctgatcttgaatcgcaagtcctagaaatattcctgtgatagtttgggttgaaatagatagtaataaatcagctatagtgagattagaaaaactatgtgtagtaccaataagtgctatactattaagcaggactcctaaaaatgcaccttgccaaccatactgaaaagctaataatataatagggattgcaaggtagaataaagcaaacctatagaaggtatctggcaatttcatttgaatatagatatttaaaacaaatagtaaaatataaataaaaatgtgctttattcttaaagttaccggcttctttattagagaagaagtaagaggaagccattcagtcttaaataaaaactcattgattaaatagcaagcaggaacaatcaataccccaccagtaaaacttacaagaaatgtgaagtaaaattctgatgaggaaatgactacagcattgatcatactaactgaaactatagtgctaagttgaattgataattttttccattgatttccactatagtataaatatgataagtaaataattgggatactacatatacttaaaataaaaatagaatattgatatatttctggaaataaatagtttaataaaatcaatatactaatttcagaacaatatacaataggccagaatttaagttgaatatgcaatataataccactacgtaaggcaaacggcaaaaatagacaggccaaaacaatatctgaaagtaaataatctgagattatccataagcagaaataagaacaagttatcaaaaaccaagtgtataatgtagtaaatataattttcattttagttgtgaatttaataaattcgctaattcaacattatttttgacattgagtttatttattgcattagatctatgaacatgtactgtcttaaaactcaaattaagtttttcgcctatttcctttggttcaaaacctaagattaataactcacaaatttccctttctctttttgttaattgccctaccggattagactgtttagatgaaactaattttgtggttagttctggcattgaaatatcaataatacatacatgaggttttaaataaggtaaatgttgacgagcttctttagcagaagaaaattctccaataacagtaacgtcactctctaaagaaagaagttgagaaaaaccagagcgtacaatgacatgatcatcaataagaacaacatgaatcataaaatccttccaattaataatagcgtatttctataaaaaatacggtggaaaagtccaccgtattcttgttactcagcatattctatcttttacgaattttttctcttctgcgattgcaacgaaggctaacaatccaatacaagtaattgctgatgcatgaagtgctgcaaaagtaccactccatccggttagaccaaaaattggagtaccgtcagcaatcattcctaatcctagttttgcaaaactatctccaattaagtaagcaaaggtaccttttacaccatcagcaacagcaattgcttttttagggacaaacccaacagcagccacgccaatcagtaattgaggaccaaatactaaaaagcctaaagcaaacaatgccgttaaatacataaattcattagttgcaaactgatagaactcaagagtaaaaacaatcagacctagggcgatacaagcggttaaggcacgacgaccatttgctaaatcagataaatatccccataagaatgtacccactaatgccccgacttcaaatagagcaaaaccggaaatagcagcatcttttgaaaatcctaattcttgataggcatatactggggaccactgatcaataccaatacgaacaatatatagaaaaatgttagcaaagcatagtagccaaataactttatttcttaatacatattgaacaaatatctgccatttggtcagttgattttcttcagtattacgatcttcctcactaatttcctccccaaataattcttccgctttacctaaaccatatgcctcaggagaatcagaaccatagcgtaatcctataaatccaataattaatgcaataattgatggaaatacaaacattccaatgacatgtccattaaagaagacattagctccgaataatgcaactccagcagctgccgcaccacctacattgtgtgataaattccagaaacccaaaaatgttcctcgtttctttctaggcgtccatttagtaattgtggagtagctagatgatccccctgtactttggaaaaagccactaagtgcatagaatgaaatcattaagaacagtgcaatgctccctcctcccatactagcactaaagccaagcatacagatggctgaaagaataagcataaatggtacaaattgttttgtatttttaccatcagcataataagagactacggttttcccaataccataagtaattgaaaaacctaagccaataagtcctaaatctgttttagttaaaccgtaagtttcgatcatatcattttgtgcgatgttgaaattcttacgaatcaagtacattgccatataaccgataaatacaactaaataagattgcataaaaggtttgaaccacattttccgtctttcttctaggggtagatctaagactgggcgtctaacttcagctaaaaatgaaaacataatttcctctgatatttttaaaaagatatttaaattttaagaaaattatttcattgctccttgagagaatcccctaaatagaataagaaaatttcctagtttagataccgttaactgtattttgtgactaagatcacattttagggtttattgtgaatttctaggaacaataacggacagatggctttttccttcaaccttggatatttctgctataaccgcaggagaaaaatgtactctctgctgtgttagttgatagactaagtcaaagacaaggggcaagtgagagataatcagcacatgctttgctccctcttctcgtaggaattcaagataatcaatcactgtgtcgggatttccgtcaggggtaatctcttcccatgtttccgcaagatttgcaaaactttgcatagtgttgaccgcttgcataccttgttctacggcttgtgccgtttgctgcgtgcgaaggtaggggctaataatcactttatctaatttaatttgttgattttcaagcctttttgcaagccattgcccttgttgatatgccatcaatttaccctgttcagttaagtttctctgtgcatcagttggggcattgaaacctgcttcaccgtgtcgcattatccaaatattcatcggtttatcctcttcgtggtttaaacagaacgcttttaggcgtataatgcacctcgttttttgttgtggcaagcaacagataaaagatttctatttttcataatttaaacaatggagtaataactaatgtctcgtaaactcagaagaaccaaaatcgtttgtacaatgggtccagctacagatcgtggcaatacgttagaaaaaatcattgctgctggtgcaaatatggttcgtatgaacttttctcacggtgtgcctgaagatcatatctctcgtgcagaaaaagtgcgtgaaattgcaaaacgtttaggcaaacacgttgcgattttaggtgacttacaaggccctaaaatccgtgtttcaaccttcaaagaaggcaaaattttcttaaacatcggtgataaatttaccttagatgcagaattaccaaaaggcgaaggtcatcaagaagcggttggtttagactataaaaacctaccaaacgatgtcgttccaggcgatattcttttattagatgatggtaacgttcaattaaaagtgctttctattgacggcgctaaagtatttactgaagttatcgtgggcggtccattatcaaacaacaaaggtatcaacaaattaggtggcggtttatctgctccagcattaacggacaaagataaagaagatattaaacttgcagcgaaaattggcgtggattacctagcggtatctttcccacaatcaagtgcagatttaaactatgctcgtcaattagcaaaagaagcgggattagacactaaaattgtcgctaaagtagagcgtgctgaaaccgttgcaactgaagaagcaatgaacgacatcattttaggtgcagacgttattatggtggctcgtggtgacttaggtgtggaaatcggtgatgcagcattagttggcgttcagaaaaaacttatccgtcgttcacgcaaattgaaccgtgttgtaattaccgcaacgcaaatgatggaatcaatgatcaaaaaaccaatgccaacccgtgcagaagttatggacgtagcaaacgcagtattagatggcactgacgcggtaatgctttcaggtgaaacggcaaacggcgactacccagttgaaacagtaaaatcaatggcggaagtctgtttaggtgctgaaacaatgccaagcatcaatgtttcacgtcaccgtatggaaggtaaatttgcaagcattgatgaagcaacggcgatgtcagcaatgtacaccgcaaaccaccttgaaggtgtttctgcaatcattgcattaacccattcaggtgaaaccgcaaaattaatgagtcgtattagctctggtttaccgatctatgcactttctcgtaacgaacaagcgttaaatcgttgtgcattataccgtggtgtaacgccagttcattatgaacatgacagccgtactattgaaggtgcgaaaaaagcattatctttattaaaagcgcaaggctatttaatgtctggtgatttagtgctattaactcatggtgatgagttaaaagaaggtggtacaaatacttgtcgtattcttcgtgtagaataattctactcattagcaaaaaatccacgcaaatgcgtggatttttttatgtattcaacaaaccaatacctgtgtcttctcgatttagtctaacgaatttcacctaccgaaactttagcatcggtatgtttattgccgataattcgatcttcacatttattgttttcatcacaaatagagacaacaacgctcttctcatcttctagtgtttcaggttgtagagatttaactccgaacttattattttcaactaaattactctgttcgcgagatagataagttggcttgagtccgttaagtttatctaatatcgtatttaattgacgctcattaagtcttttgatatttccttctccggctagctcatcatcaccgtagtttgttcctctcggttgctcataaaatgtaaaatcagtatttttcaacacgataggcatatctttatggctgtaataggctttagcaccatttggagctagtgcaataaccgtggcattctcaatcgtagtctttgtagcatcgccaagggctaaagcaaagttagctgcatttgcatcattatccgcagaacctgtaataccaatttcaggtgaaggtttaggaccagtatttaacaaggtaatagttaaatcattttttgatttttcaccgcgtaatgttgcatttttatctgtcatcaacgtataaccttgatggcttttcaggttaattgaacttttatttcgcccttctaaatcaccaacgacatacattgttgccgctttcatttttgaacttggtgaaacattcagtttttcagccccctgaatatttaatgacgtgtgatctaaaatcgttttatctgcacttaacccaattttatggatacgatcgtaatcagattcaaaagacatatttcggtcaaacgtaacattaaattgactatcggttaaattaatattttttgccataagattaataaaaccatcatgcgtttttatattactattacgaatattaattgtcgtttctaaatgacttttaggtgttttaataacttcttgtttaattttgtcataactattatttgtggcagtccaccaatcaaatgcatataggaactcattattaatccattgacgtaaattattattgaatttccatcgtctttgagtatgatttcgttctgtacgcaacgctctatctttggtattgaaaatcgcatagtcatagcttggtttttctttattataggaatatcccccataaatatagaaattacctcttcctatatgagtaagacgatcaatatcaacattattaaagccaccaacaatgacaaaatcatctactttatcaagttgcaaattactaatatttacgctaaaaggcgatctttgagtatcttctaaacaataggcaagattaatacaagttctagaatcttctaaatttcttcttaaaccatttctacctaaaacaatagcaccattattaaaattaaatttactatctataatcttaatatctgaaatgcctttatccgcaaaatgtttatccattaaatctgtcgcaataaataaacgcccatttttagtatctatatttgctttattaaaacgaatatagctaggattagtataatttaattgtgtatttaataataaaactgaatcagtatctttatatgagtctatatttatatcacctgaaatatcaaaattatgcgcatttagatttacttctcctgaaatacccagtaaagaacctaaaaaattactgctgataaaagaattttcacctacttttttattaccaacatcaagattatctgccagctttagattaacttttgtttttagttttttagagccgtcatcataatagtttttatcttcccgacttaaatcaccactaagattaactttctttatagctgggtctagatagctactgactgcaaaatcaatactatctttaattgtaagttttgcacctttttcagcatttaagttaatttcattctttttcgcttttattgttaaattttcggcttgaatatcactattttttccaaatttaatatcatcagaaaataaagttatttttccagatcgagacattacaacattatccgcctgtaataagccatcgttattcacaaggttattaattaattcattttttcccttagcagttagctcaatataaccatcttcggtaataatagaacctgaatttttcacaatactatttactgtattttcttcaatatctaaatcaatagatgtcgtatctaattctaagctaaattttccgccagcgcccaagacaacttgtccagggctttcaatagtttcatcacgttcaaaatcaatccacttaaatccccaaggattaccttgacggcaatcatttggatcgctccaactactattacaatagcgacccttaacttttttctcttgtttaaagtatttagcttcaattgtccccttattttcaacatcatttccaactaaaacaacaaatgcattttcgccatttgcaacaattttaccctcattaataatttttccttcagcagttttatgatttttacgtggagtaaaattgaaattattactattactaattttttcaagatctttagttgttgcaagtaagctacccacattgatttcagcacctttggttataataactccgttagggttagcgagaaacactcgcccatttgcttgcaatttaccttgtatttgacttgcatttccgcccataacacgattataagcaatagcggttgaatcaggctgcttaaattcaacactattttgttttccaatatcaaaactttcccactcaatactcactctaggtgattcttgagtaatggtcattgccttatttaaggtattaatttttgcattgccgtctgtaattttatggttttgaggtaagtctgcagcataaagatttgttgtgctaagtgctgttgaaatagctacggaaagtaaagtttgtttacgcatttatgtactccttaattaaaatgttttaattgcagataaccaaaattgatttttatctacattgttatatttcttaccgataggttttgcataagcaaaattaatagaataatgattaggttcaattaaattcaaaccaacaccgatactttttaaacgaactttattttcaacagattcggataatttctcagtatttttatattgttttccaaaaccctcatcataaaagagtgagcttactagcatactttttgaaaaaacaggtaagtagtgttttagttccgcttggataatatgcccttcatcaacagaaacagtacctgcttgatatccttttacccctgataatccacctagtaggaatttatttccactatccagatttttatcagcgaattgcccactaacggcaaacgtaatactgaaggatttaggtaaaaattgctcgtgagataatgaataattaaatgtcgtaaatgtacgtttaggctggtaattctctgataaatagtgttttttctcattggtcgaatgactttctttcccaaaaatagtattgaaagaaaaataggtaacaccttcttttatactattccaagaaccactcactcctatgctagtcgtatttactttccgtttttgttgtaaatcaacagatttttgttcatctgacaatttctgatgattaaatgctaatttactatctaatcttaaacttgcagttctaatagtagggtgagtaatataaccacctaaattataagtactcccttgagcattaagatctttaaaattcgcacctaatttatattttaaatagtttgaattcacgccgactcttgtgccatatccatcaataataaaagaatagtccgctcttaagttatataaatcgaaggtgttagaagcaagcacatcaaaatgtaattcatcaccaagcccaactaagttataaattttatttcccaatgttgttctatattttccagtattatcatttccttgattatcaatggaaatatatcccccccaacgtttattatctttaagattaacagtaagatctgttttacctgtattttttcctgctttcaaagataacgctgaggtaattcctttaatgtcattaagtaatagagctaacttttctagttcatttttaaccaaatacgaatggcttttcacagtagtattcaccatccgcataaccaagtcttcttttaaacggcttccatttctaacaactacctgatcaagcgatccctttatcacgaaaatttgcaattcaccattattaatttcttgtggtggaataaaggctttagcaacaagataattgttgtcacgatagtagttagtaatttgttgcgataaccgatttaagtcatctaaggtgatttcttgatgaagataaggagaggtaatagatgtcagattatcttgaatttcgtttccgtccaactccagtaatttgattgaatctaaacggaatttaagactttctttgttggcgggaagattctcttcctgtgttggtgttttgaacagttctccagatggttttacttttgctacttgtatctggcgtgtctgttccaactgtttgttcaatgttcctgaatctggtattggatttgcataagtaaagccagatatacatgaaataatgattccagtaattacattttttctatggaaatgtttcattttgataggtctcctttattaataatgtattagaacgctttttctattcatttttaactaaatgataagaattatcaatatcattattgataatttacattatcttttgtaggatatttattagtcagactaaaggagcaactaaaatgagactatcaaaaatttatacagcactctttctctctttgcctaccgtatcccttgcagatagcaatgtttcagctgaactcgctgaaatctctgtgattgcaagtagggatgcatttcactgggcaaatcacacaagtgagaaagcaaccctaaataaaaaccaattattaactcaacaacccataagtacagcggatgcgattaaaaggattacaaacgtggatattgctggcggatcaaggggaattgcacaaaagccgattattcggggcttaagtggtaatcgtgttgttcaagtgattgatggcgttcgccagaattttgacttatctcaccgtggttcatattttttacctatggcactaacccaagaaatagaagtgatcaaaggccctacaagtactttatggggcagcggtgcattagggggaattgttgcgatcagaacaccaaatgcacttgatttattgaaagataatcagcaaattggagcaaaaattcatcaaggataccaatctgccaattctctctctgaaacagatgtcagtgtctttgccgcaaatgacaagtttgatggattagtgagtggcttttataaccacgctgatgatttacgtttagcggacagtaaaaaattagtagacagtcgctatactcaaaaaggcggactttttaaatttggttggcaaattaatgatgaaaatcgccttgagctttctcatcgtttaagtcattttgaacaaattgccccaaccaacaatgaagttgctgaagaatttaccaaccaagatgtgagaaaccttattagaaactggcatagaaataatccaacagcttcttttgctgaaatgactcgtttctataaaggactcacatcagtactaggaagtgtaagttatcgagctaaacaaaaaatcacagaccaaagtagtgccttacactattactttaaccctaaagacaatgattatatcaatagtcaattgacgctataccgtaacagtacaaaagaaaaagagcagcgtattgcaagcggtttgcaagatcaaactaaactcagcactatgggtttaagcatacgaaattcgacggatctaaattggttagccctaaactatggtgtagattttatttcagaccgagtagtaacacagcgtgagaaaaatgccacaacaccattccgccctaataattatgacgctaaatctaaaaacagtgcattttatcttttaacacatattccattatggaatgaacgcattattgtctcgccaagtgttcgctacgatcactttaaaacacaaagtgacgaagccaaatatagtgcaagccgttggtctccatccatcgctgcaacttggaaagcaacaaattggctagatcttagtactcgttataataaagcattccgtacaccatcaatgcaagaacgctttgtcagcgggtctcactttggcacaaatttaatgggacgatcatttaataatacctttgtaagtaatccaaacttacgcccagaaaccgcgaaaaataaagaaattgcggcgaaagttcattttgacaatctctttgtacatcaagataaattcatcttcaatgcgacttatttccaaaatgatgtaaaagattttattcatcttgatattttccgagcttcacaaagagatatgattccatctctctcgcagtatcgaaatgtagaaaatgctcgcttaacagggtatgaactagaattcgcttaccagcaagaacgtttagcattgggattgaattatgctcaaacaaaaggtaaaaaccgccaaacacaggaagccttatccaatattccagcgaataaattaggctttactattgattatgcgttagtgcctcaaacatttatgattggagctaatatcactcactatgcaagtcagaaacgagtgcctaaaacacacgcaatgacttatccaagttatactctcacagatttaaaagcaagttacacaccttctggcgaatggcgtaatttacgtttagatatgatgatcgagaatgtctttgacaaaaagttccaacctgcatttagcttaatggaaggggctgggcgcaatattaaattgaacgcgtcttatcagttctgatttttaacaaatattatcttaaaaaatccacgcaaatgcgtggatttttttatatactgcttccatcaattcctatcaaatttttgcttatgttacctctactttatgccttaaaaacggagaatgtgatttctgaattaaactatcaatttgcaaaaatgatcgatcagaaacagcaggcttataactatacggttcaacaacagaatgtagcaatctttctaagtgcattagtttcttttaatgttatgcaaggacatagttgtgttcgtttaaattctgatttaacaacccacttttttgacttgcaaaaaaagcatttcagccgtgattttcatacggagattttgcaaaaaattgaggggatttcaccgctagagtggcagtcgttgctacataaccatgttgcttttagccaagatcctacacaggttgcacctttattatttcaacaggatcgtctatatttttatcgttattggcaggcagagtatcgtgtagcacgttatttacaacaagcggtaagttcggatttaaaaaaagcagatatcgatcttcatcgtcaaattttacaacgcttttttccaaaacaagctgatacggattggcaaaaaattgcggttgcaacggcattaactaaacgattctgtctgatttcaggcgggcctggcacaggcaaaacccgaacagttgctattttacttgcagcattacagcttaaacaattagaacagaaccaaccgcttttaaagattgcccttgctgctccgacaggaaaagctgcggctcgtttaaaagaatctatttcaaataatctcgctagtcttgatcttcctgacagtttgaaagctgaagtacccactcgagcttcaacaatccattcgttaatcggtattaatctccatagtgatctacctcgccatcacactcaaaatccactgcatttagatttgttagtcgtggacgaagcgtcaatgatcgatctcttcatactggaaaaactgctgaatgccttaaaaccagatactcgtttgattatgcttggggataaagatcaacttgcttctgtagaagctggaaatttaatgggggagttgggtagtttgatcagatttggttatagcaatgagcatagtgactatctaaccgaggtaacagaacatcaaatttatcctacagtggaaaatgtccccgcaatttgtaattcattatgtcatcttcgtcgaagttttcgttttgacgaaaattcagggattgggcagttagctaaacaagtgaacacccaacaagcggtgaaatcgtggcagattttaacgaatagggcttatgatgatttaacattagcgtgttaccctaaagtcacggattttcctgaaaaatcacaatggatacaatactgtgtaaatagcgtggtagaaaaagcggtggagttatattccgattacttgaacaaagtgaaagctcgagtactttccccagaagccgtgtctatcggtgagatatttaaagcattccaacaagtacgctttttgtcagccttacgcgtcagtgagttgggcgtagaacggcttaatcaaaccattgcagaagcattattgcaagcacgtctattgcattttaaacatagccgagacagctacattggcaagccgattttgattaccgaaaatgcccctcaacttcatatctttagtggtgatattggcttaattcttccagatgaagcaggaagattgagagtatattttgaaacagaacaaaatggaaaacatttagacatttcccttagtcgtttgccaagttatgaacccgcctatgtaatgaccgtgcataaatcacaaggttctgaatttgatcatactttattggtaatgccactttctcattcgccagtattaacaaaagaactgatttatacggcgattacccgtgctaaaaaacagtttaccttgtttagtgaagaaaaaatttggaaacaagcagtaaaagcagaaattcaacgacaaagtggattaaaagaacaaatattggcagatattttaatgaaatgatttggaataagtggactataatccacagaaatactttagaagatgttaatggcaaattgcagaaaattctgtttcacattagaatagggtacatattcttattgatcaatgaggaaaaacatggaaactatagaaaaaatccaaaaacaaatcagcgagaatcctattcttctttatatgaaaggctctcctaaattcccatcctgtggcttttctgctcgtgcttcagaagctattgtaaattgccaagttccatttgggtatgttgatgttttatcgaatccagatattcgagctgaattaccaaaatacgcaaattggccaacatttcctcaattatgggtagatggagaattaattggtggttgtgatattgttctcgaaatgttccaaaaaggtgaattgcagaccttgttgaaagatactgcaaaaaaatattctctatagcgtctaacaatcacattattttgcagagcttgttgtataaaacagctctgccctcaattaacttcttgattttctttcaattactgatcatagtatcgctctataatacttatttcaaataatacttaattttggcatcatgattaaacgtctcatttaattagagattattcctttctatactttttaattatttgttaaaaaattagagctatatcacaatattcctcccaaaatttaggtagaataccgatgatttcatttattcaattgtataaaggacacaactatggatgacaaatctcaattacgccaagcagcacttgatttccacgaatttcctatccctggtaaaattgaagttaccccgactaaatccctcgcaacgcaacgtgatcttgcattagcttattcgccaggggttgcagagccgtgtttagaaattgaaaaagacccagccgccgcctatcgttatacctcaaaaggtaacttggttgctgtgatttcaaacggaactgccgtgttaggtttaggcaatatcggtgcattagcaggtaagcctgtgatggaagggaagggcgttctgtttaagaaatttgcaggaattgatgtatttgacatcgaaattaatgagaaagatcctgaaaaattagttgaaattatcgcttctcttgaacctacctttggtggtatcaatcttgaagatattaaagcaccagaatgtttttatatcgaacaaaaattgcgtgaacgattgaacattcctgtattccacgatgatcagcacggtactgcaattatcagtgcggcagcagtgattaatgcgttgcgtattgtggataaaaaaattgaagaggtgcgtttagttgcatcaggtgcaggggcggcttctattgcttgcttgaacttgcttgtatccttaggtatgaagcgtgaaaatatcgttgtctgcgactcaaaaggggtgatctataaagatcgtgacgatcgtatggacgacaccaagaaacattattcgattgatgataatggctggcggacattaggcgatgcgatgccaaatgcagatattttcttaggctgttctgcggcgggtgctttaacgcaggatatggttagaacaatggcggctcacccgattatcttagcattagctaacccaaatccagaaattacaccgccagaagcgaaagctgctcgtccagatgcgattgtctgtacaggacgctcagactatccaaaccaagtgaataatgtactttgcttcccattcattttccgtggtgcattagatgtaggcgcaacaacaatcaatgaggaaatgaagcgtgcggcggtttatgcgattgcagatttagctcttgcagagcaaaatgaggtggtcacttctgcctatggtggcgaggggacaacctttggtgcggattatattatcccacgtccatttgaccctcgtttaattgtacgcattgccccagcagttgcaaaagcagcgatggaatcaggtgttgctactcgcccgattacggattgggaagcctaccacgagaaattaactcagtttgtctataaaaccaacctctttatgaagccgattttcagccaagcaaaagcagagaaaaaacgtatcgtgcttgcagaaggggaagaggacaaagtattacacgcgacacaagaagtggtttctatgggcttggcatatccagtcttaattggacgtacggaaattattaaagccaaaatcaaaaaattggggctacatatcgttgcagggcaagattttgatgttattgataatgaacataacagccaacacgatgagttatggaaacgttattacagcataatgaaacgcaaagggattaccgaagcgatagctaaacgtgttgtaacctcaaatacgacagtcattgcttcattgctcgttgaaatgggttatgctgatggattagtgtgtggcttgtttggcacatatagtcgccatttagaagctattcgtgacattattggtgtaaaagaaagcgtaaaagtacccgctgcattaaacagtttggttttaccgacaggaaacgtttttattactgatacctatgttaatgcagatccaacggcggaagaactcgctgaaattaccttaatggcagcaagagaaattcgtcgttttggtattgagcctgcggtggcactactttcacactctaattttggttcatcaaatatgctaggcgcaccaaaaatgcgtaaagtgttagagattgtgagagagcgtgatcctgcgttaatgattgatggtgaaatgcacggtgatttagccttatcggaaaaattacgccgtgattatatgccagatagcccattaaaaggttcggcaaatttacttataatgccaaatatggaggctgctcgtatcagctataacctattaagagcgacgacaacagcaattaccgtaggacctatcctattaggtatgaataaatcagcacatattcttaacccagtgtcttctgttcgccgtatcattaatatggtggcgttcgcggcagtgaaggcttagtaaaaatgaaatgagcgtgatttttcacgctcatttacttcttattcctcaagtatttttctaaaattgtttttgatgattatggctgccttgtttttataatcgctttggattctttatccatgataacttcaattttatgatctacaaccacattcatattaatcgtaataccttcaggtggtgtttcaagttgtactttgggagtacaagcggtcaaatttaagcaaaaaattgtaaaaagtgagtatatagctttcattcttagaagggatttgatttattaggtttatcttatttaatcatcttttttctttaacaatgaaataatctctttcaaagcaatgatttcttcatttttctgagccaacatctcgtctttatgggcaatagtgagttttaatttttcgatttcggcggtgagattttcatcgtaggcggggtatccccgcctaaaatctaagctattgcagaaatgcctttatgttgtactaaagaaagcagtttcagtgcggcaccgcttggttttttgacacctcgctcccattctgaaactagattgctacttacatttaagtagtgagcaaagacagattgagaaaaattttctttctctcggatttctcgaatctcattgggagtgagcgttttaactggcgttaaacaacgtttgtcaaaactctgcattgttgttttatcaactaaaccaatgtcgtgtaaatcactcatcaattcgtggatcgctgcatttgctgggctgttgtattggctcatttaaacctcaaataattttgagaccatcataaaaaaataagttcaaaatatcaatatatcgccttatgaaaaaacacttaccccttaccctttttatccccctagtagcaaacgcaaaccccgaattggaaatcaaatccgccgagcctacattaccaaaacaagcggttattttttcagaaaaatccgcaaatagtgaggaagtcactttaactaaagagcttattagtaagcctgaactgactcgtcaaatgttaaatcgggcgattgatagccgacaatttcatttattgcctgaactggtgcggatttatcaacaaacacctaatcccgatttgatactgatcgattatgccaacggcattattttggcaagtcagggggattataaaacggcaattgatctctatcgtgacattattgcgaagcaccctaattttcagcctgtgcgttttcgtttggcacaaatgttgtttgaagatcggcaaaatgaagccgcacttgcacaatttcgtaagctacaagcggacggattaccgccacagattgcaaatggggtggaacaatatattgctgccattcaaaaacgttcggattggtctttcgactttggcattaattatttgcacgaaagcaatgttaataatgcctcaagctcgccttatgttcgagtggggaatgtgccgtttaagaaaacggaagaatcattaccgcaatcagcaaatgggttgagctaccatctgaatttggctaagaattggaatgttagcggatcccattatctacattttgagaaccaatttagtggaaaatcctattgggataatcatcaatttgacgatcagcaaaaccgttcaagtcttggctatcaatatcaaaatgctcaaagtcgtcttgcttttttgccttattatgaaatgcgttggtatggtaatcatcgctataatcacggctatggcgttcggggagaagtagagcattggcttacatcacaatggcagctttctacggctggcgaaatgggcaagctcaaacatcggggcgaaaatcagcttgcagatagcacaacattatttggttctgctacgctactctatgcctttgatgcgaaaagttatctctatggtggtgtagatttgttgcgagatcggacgttagaacgttctttagcctcaaaacgttatacagggcgaattggttgggggcaagaatggtggggcggaatttccagccgtattcagctcagttatggcaaacgtgaatttgaccaagctcaccgcatttttaatcagatacgcaaagatagagagttaggtttgaatgttacactttggcatcgtaacctgcatttttggggaattacaccgaaaatcagctatcaatatcagcgagtgaactcaaatttagtggatctttattcgtataaacgaaatcgagtttatttgagttttgagaaaagtttctagtaaataagtggcttagataattctgagcccttagcatgtactgagtgcggttattgtttatctaattgtttatagattgagtgctcaatattctgctcaaactgagaaccgtagttaatcaatttccacaggtcgaacatattctctttatggttataattcaaattgactttcgcttgtttatgctcagtcaatctagaatggattttagctgataaatccatatcgcctttactgtctaaattcaccgttgcggtgaaatcgtcaatctcacttttattgaccatataagccaaaatctgttccgtatagcccccttgtttaatcgcttcaagcaattcaggggtaaattttaggtaagatctatccgcttgtgtcaatgttccattgcagatgtagcaaggtttacccgacagccaaaacggaaagataccgttgaatttgccagttaaatccagttggtgatactgtgccaattctaaaatgcgttcaaaacgaatatcaaacagctttaaataagcgattttcgtttgtggcagggcaaagtgttcgatatttaaacgtccatcaagcaaatttaaacttaactctcgtaaaaacagaggcttacgtttagtgtaaggtaagtgtccttgaatttttactttgacattggttatcggaatacccatattcacttcatcaatattcacatcaagggcttttttcacaccaatatctacttcgccctgtttgtattgataagggagtgagaaatcaatgcccttgatctcaccgtttggtagagaaaccgcaccgttgcgaatagcaaaatgcccaccagccatcaacccacgagctgcattcgcactaaatgacgtttcacctttgatggtaccgtttgtgatgacccattggtttctaaaaggaaaaaggctttggaatacatttgcaggttgctctgaccaatatagcttaccgattaaatcactggcattattggttaattttcggcgagcaaagagtttaatcggtcctaattgattggcggtaacatcacccctaaagttaagattttccacttcgccgtaaaaatttaagtgtgccgttggcttttctaaagtgccaccataggcaaaattaatctgcggagaaaagagttttattcccccagtgagatgaaatttatcgtaatcaaagttaatcggctcattcaaaaccagctctgttttgggaatggataccccatttttaccaatctgttccagactgcctttaaattcagatagttgcactaaatctttatgccacacaccacgcccagacaccgcaagcggtcggtttaaggcttttatttgcgaactgccccaaaaacgccaattccattgatctttcaccgcttttttatcggttggatcttggaaaaagtgtaatgctcccgctttgaaattgttggcataaccgtccaaccgcatttcaatatttttaaagtcagggctttctccacggaaaatcgcttgcaatcgaccgtgaatgccctgcttatctacccgtacgccagcaaggggaaaacgcaaatcgttgatggtaagaaagcgttcagtcccagttagacgtaacaaagcaccttgcaaaaagcgtaaggtgagatcatcaaattttccccttacatctaaaggaatagtgctatataaaatatgctcaccttgtttgatattacctgtaatttgtagtggcaaaatcaaactgtcttgctgaatttccccttgtggactactgatcacaacattgcctttccctttggcattttgagtaagtaagctgatacgcaccgccgtttttatcggataaagctcatctaaggaaaaacggttaggactaatcgtagttgtcagatatgcattgagcggaaaatcatttgagagttgccaatcaattttccctttttcaatcgtcaggctttgcgtatcaaaatgaaacggcaagttgaactgattttcaggtgttatggcggaatttaactgccaatttccgtgaagttgttgatcttgtttataccagttgagcgttgaatgtccttgttgcaaacttggttccgcaatcaaggcttcaggcaaatgccactgataattcaagctaagttgctggggcaatgctagaaaatgttcatctaactgagcagaaagtgttacgtgatgttgctcatcattatttggttgatagctaagttgtgtggtgagttgctgatttgcaaaatttgcgtcaaatgtgaccgcttgttgcttaatgtaagcggtcagtttttgctgaaaaaatgcaaatttaatttcacttggtgattgcagtaatcccttcaaacgttcatgcatttcgttgggaagatttttccacgccaaagatttgatttctatgttaccttctggcagtaacgcaaggatagttttaatggtttctgtgggatcggtttggcttttttccgatttaggaaaaagagatacgcaggcgtaatcaacagtcgcttgattaagacgaatagattgttcatcaagccattgcaccgaaaggctctctgccgaaataatcggacaatgttgatagtaaatagtaaattgtggcaggattgctttttctaaatgtggctcaataccatagggtgtttctattttccagcccgttggcaatacaagattaatcgcagaagctaattgagagcctgaaagcaacgatgcaccgccagccattaaaatggcaagtgccgcaccgataatcaataggcttctgcgtaacatttagagaatatttgttaatggataaagcattgcaaggaaggtagcgaccgtccaagcggttggatttttgatgttttttccctgtttgccgagtagcaaccaagctaacatcatcaaaatcacaaactgaaccccaaagaagataaagtaaggataaatcaccatctcaggcataatcgcaagttgttgatataacacgaaaatcacccaaacatagttgatgattaataccataagtgctaacaataccaacagttttaaaaagccttccaaacggcttttcgctagcattaaataccaaccgcttaataaaataccgagtaaaatctgggcaaaattattggctctaatccagttaaacagcgacggtacttcataccaataaatcagcaaatattgcaccataccaatggcggtgatgcctaagccacaataaatcaccgtgcgataaatatcttcatctttgggcaatttccaatagataaacggcagaataacagaagcaaatccagcgactaaagcaggggaatgtttcggggtaaaggcaagggaatagagaaaatttcctaccgcaaagactaaaagccacgacaaaatagccgttaaacgccctttttgccctgggcaaattttccctttccacagtaccacgaagctaatcaaacaaacgctaaaaaaggtgagcagataaggcgaaacaaagattgcattttgtggtgcaaaatagtgattgagcgacatttcaatcaataacatcgtcaccaacggcaaaatagcgtgcgtggcgatttctaatttagaaggtgtatcgtgatcgtgagccatagtttcaattcaaaaatgattttagggcgagattatgccataatattggcacttttttctatttttaagaggattttacgatgcgaattttacatacaatgttgcgagtaggaaacctagaacgttctatcaaattttacacagaagtgcttggtatgcgtttattacgcaccagcgaaaatgagcaatataaatatacccttgcatttttaggttatgcagatgaaagtgaaagtgccgtgcttgagctgacttataactggggagttgagagctatgagttaggtactgcttatggtcatattgcgattggggtggatgatatttacgcaaccgttgaagcggttcgtcaagcaggtggaaaggtcactcgtgaggctggtcctgtgttaggtggcaaaactgtgattgcgttcgtagaagatcctgatggttacaaaatcgaatttatcgctaacaaagatgcacaaaaggcgttaggttaatggctgaaacagaagcaaccaattacaatctattgaaaaatcgctttcgtggctatcttcctgttgtggttgatgtcgaaacggggggattaaatgctcaaacggacgcattgttagaaattgcggcgattacgctgaaaatggacgacgacggctatttgcatttagatgaaaaatttcatcgccacgttaaaccttttgaaaatgccaatatcaatccagaggcattaaaagtaaatggaattgatgtagataacgctgagcgtggtgctgtgccagaagatattgccattaccgagatgtttaaaatggtacgcaaagcggtaaaagacaacggctgccaacgtgctgtgattgtggcacataatgcgacttttgatcaggcatttttacaagcggcggtaaaacgcattaataccaaacgagatccgttccacccttttgcaatgtttgatacggcaaccttggctggttttatgtatggacaaacggtcttagtcaaagcttgccaaatggcacaaattccttttgacggcaaacaagcccattctgccttgtacgatacggaacgcactgcagagctgttttgtgcaatggtgaataaattgaaggatttgggtgggtttcctgatttaaaggctagaatgtagtaaaaggtgagaaattagaggcgcagcttaatttctcactgctattatacttaaatatactatttgcgatatttcccagccatagcctgataaatggcattctcatttttgagcagggtatatttattttcaagcaacgaaagctctgagctacgttcggtgttcattgcacttagccattcacgcaattcagagataccttgatcgtagcggtttttataatatccgctgatttttctatcgtactcatattttttctgtaaattcgcatagccactttttgacagttggtaagtggaatagtaggtgtcgatttcatttaatgcggttgttactgtctgttcatagttcaatttagccagcttataaccctcttctgaaatcttaatgttattttgtactctgttccaatctaagaacggcaaatcaaaagacactacgccaccagcgacagggttatctgacgtattgttaaacttcgtcgaacttcctgttaggcttccccctaacgtgaccgttgggaaccagctattttcagttgcagtaaggtttttaaatgccccttgtaaacgctgtaagcttgccagtacatctgggcgattagcaatggttgaaacaggaacattcacatcaacatcttgtaatttgaccttaagaatactcggataattgactacaagcggttcgttcggttttaaatttagcaaattacgcaaaacttgctcactggatttttgagccgattgtaagttgattaaggtattttgtgcagaaagcaccgcttgcattgattgatctacgctaagctggtcgattaatccctgtttgaatttattgcttaaaatgcggttgatctgctcatagctttttatgctttgttgagtaatgcggattgcgtcttgataataggcaagattgtaatagctactcacaacggcattaattaaagataatctcgccgcttgtaaatctttttgggtagctttgtgttcccattctgccgcacttgcggtatctcttaaacgcccccataaatcaagggtataacttaggtttaagctaatttgatgtccaatacttgatgtgccagtcgagtttaggttactgctagaaccaacaccttttgaagcagaagatttttccgaagcagtgaaagttgggactaaatttgcccccactaagtttgcattatataaggctttattcacggaaattgccgtttttgccaaattgatattattggcaagtgccgtttcaactaagcggttaagctgggtatcattatagccaagccaccattgctcattgatttgatattgtttcgtaatgtcttgatattgttgataatcttgctgtgctttttgtagagagccatcgttgctcatattggtacaagctgaaagtaccagtgcagaaagtaatgtaaaagtaagttttgacactttcattagaaattccttgattaaaaaatgatggggcgtattttaaagaaaacgccccatttcgactagctctaaactgaacgatcattcattttttgcaaaaatttacataatgtattgacttgttgatcaatttctatcgctatataattttaaatataatgattttgtcttaatcacagaagctagattatgaaaaaatttctttctacattcgctttattggcgtttgtgacaagtggtgtgtctgccaatgagcagccgatcagtacccattttggcgatttacccaaagctgagcatgtacaaaaaattaaatggaacagcttttgcaatggaaccctgacatcatttttacgcaatttactgatattgagtttgctcttattactggctattttgctttcgcttaatctcggaaagtatccgatttcgccgacagcactgtggcaagcggtcgtttgtgctttctctgttgaatgcgaaaccaaccaagttcaaacggtgttatggcatattcgagtgccacggattattgttgcttgcttagtcggggctgcactagcttgtgcagaggcaacctatcaggggatgtttaaaaacccgttggtttcccccgatattctaggcgtatcggcaggggctagttttggggcttcgttggcgattttttgcaatttgccgatgtggtatgtgcaactttttgcatttgtcggcggtattagtgcggtattgttggtaactgtgatactggaaacgaaaaacctaacgattggctatgccagtcagcctttgatctcagggatcgattttcgtctgggaacaaatgacatctgctgtgtgttaggggcaaatggggcagggaaagtacctttttacgcacgttattgggtactcaagcaaaattgcacggggaaattttctttgcaaaccaaccgcttgttacctattcaccacaacagttagcccaacaaattgcctatgtgccgcaagcgcatcaaagtttatttccctttacagcacgccgattaccttgcagatagcgttgtgattttagataagcaacatcagccagcctttcaacaagggaaaaaagccgctatgcttactcttcatcaattagccaaaacctatcgtattgatatggcgagtttggctcaacatttaccttttaaggaataacatgaattcattctacgacattgattttgctcaactttataaacaacatctgattgcatgtcgttatcatgatgttaccgctgagaaatgggataagaaagcggttagatttgccgaaactttgttgaaaaagagaacagttatacccgtcaatttctagataaaatgaagattgaaccgacagatagtgtattggatattggctcagagccgggaacgcttgccattcccctagcccgtttatgcaaacaagtttacgccttttatatctatctgttaaaccgtctttatcagcgtggtattcaggcataactgactttttacagggagaaacagggggctttcaaggggaaacataccaagatctgcaaaatgccgtagagttttcgctagggacattaaccgaactagaacgacaaaaattacaggccttctatcagcaaaaacagcaatctcaacaaaaaatcagccacgatcaagcccgttgggcgtttatttcgtggcaggtgtagaatatcgacaaatataagcggtgtgattttgcagaattttctatataacctaattgcgatggtataaagaaaaagtcttcaccctagctcaaatcctgagacattcctttaagagaatatatcaggctttccaaaacaatattgccctaattacatgttcaatactttcattttgcatattaaaaaacagtggcaatctcactaaccgctcgctctctttagtcgtccatttgtcttctccacaaaatcggccaaactgctgccctgcagggcttgaatataatggcacataatggaagaccgtcaaaattccttttgatttcattgcattaataaaatccgttcgcaccttgagattttgccattttatataaaacagatgggcatttgcttggcactcttggggaatgtagggcaattccacaatccctttctctgccaaaggctgtaatgcgtcaaaataacattgccaaatcatctgccgtttttgttggatttgttctaacccttgtaactgagcataaaggtaagccgcttgtatttctgacattaaaaaacttgagccgagatctcgccaactatacttatctacttcgccacgaaaaaattgctgacgatctgtgcctttttctcgaataatttcagcacgagcggtcagttcaggctgattaatgacaatcgccccgccttctccccctgcggtgatatttttcgtttcgtggaaactgtaacagccaatatgcccaatcgtgccaagtgctttccctttataaaacgcattaatcccttgagccgcatcttctaccacccataagcgatatttctgtgccaatgccataatgctatccatttcacacgccacacccgcataatgtacagggacaattaccttcgttttgggggtaatcgcttgttctatcaaggcttcatcgatattcatcgtatccggtcgaacatctacaaacacgattttcgccccacgcagtgcaaaggcatttgccgtagaaacaaaggtatagcttggcataatcacttcatcacccgattgaatatcaagtaaaatcgctgccatttctagcgccgctgtacaagaaggtgtcagtaacactttatgggcgtgaaaccgttgttcaagcaattgctcacatagacgggtaaagtgaccatctccagatagcttatctgaacagatcgcttgctggatataatttagctctgtacctaatacaggcggttggttaaaaggaatgttttgcatcatcgataaaaccaataataagtgccgctgatttttccgtttaagcgttgataaagccgaattgcagctaaattgctcagctgggtggtaatcaccattttcgtcgcttgctgacgtttcgcccaagcgatcgcattcattaataagcgatagctaaccccctgcttccgccatttttctgcgaccgccaacaagccaatatgtgccgtagtctcttttactcgaagggtaatcatcccttgtatttcaccgcttgtggcttcactgagtaaacaaatatcgtcaaattctcccttaactgcatttttaatccattgccaataaaatcgacgattttctaacaatgaaaaccaaggcgaacgaaaacgcgtttgtgaaaacaaatgcgaaaagggttcaagttgaaccaaatcctgttccgttgccacacgacaagcggtcagttcaggtgaaaaatgtgcaagatcatattcaaaaacaatctcaccttctacaaactgaaaatcttgctgctgcacccaagctatttccgttattgcccagcttggcaattttgtttgaatgagagagaaatcagcgagaactaaatccgagttgctccctttactaataagatccagatcagcgatatttcgaccaaaaaaattagaaagccaaaggtgcttatacatttttcctctcttattcattaattatctttcacatatttaaactaggctgattttagtcatgttttttcattatattgaataggagcaaacatatatccgatattttttattgtacgttatatattgataagtgacgataaaataatttacacattcaatctagccaaaagttttgtaaataggtacaatcaaacgcttgcattttattaacatttgcgaagaaaaatttaactttggagaacgttatgtcgtggaacgaatcaggcaatcagcaagatccttggggtaaaccagggcaaaagaagcctgaacaagaacaaccttcgggtcaagaaaaagagcctaataagcaatcaaatgaaccgcaaccacctgatttagaagaagtttttaatagtttattgaaaaaaatgggtggtggtagaggcaatggctcaaaccaaaataaccgtccgcctgtttctgcagggaaattcttgcctgtcttactcggcttaggcttagtggtatggggagcttcggggttctatactgttcaagaagcagaacgtggcgtagttacccgttttggcaaattacacgaaattgttttaccgggtctaaactggaaaccgacttttattgataatgtaacgccagtgaatattgaacgtgtgttagaactgagaactaacggctctatgctgacccaagatgaaaatatggtgttggtagaaatgactgttcaataccgtattgaagatcctgcgaaatatctctttagcgtaactaagcctgatgatagcttgaaacaagcgactgacagtgcattgcgttatgtgatcggacatatgacaatggacgatattttaaccacagggcgtgcgattgtgcgtgaaaaaacgtggaatgccttgcgtgatattatcaaaaattatgatatgggattattgatcaccgatgtgaacttccaatatgctcgtccgcctgaagaagtgaaagcggcatttgatgatgccatcaaagcacaagaagatgagcagcgtttaattcgtgaagccgaagcctacgcaagagggcaagagccaattgctcgtggtcaagcacaacgtattttagagcaagcaaatgcctacaaagagcaagttgtgttaaatgctcgaggtgaagtacaacgctttattcaattattgcctgaatataaagccgcaccagaagtcactcgtgaccgcttgtatattcaaacaatggaaaaagtgatgaaaaatacaccgaagttaatgatagatagctcaaacggcaataatctaacggtattacctattgatagattgatggctaaatcaacgacaaatgaagcggtaaaaacaccatcatcacaacctgttattcaacaacagccgcaacttgctcaacctgtcagccctgcacaattgccagcggtggaacagagtgagcctgtgcgtaaagggagattttaagaatgcgtaaattacttttacctgtgctatccgttgttgcatttatcattttccaatcggttgtcgtagtacaagaaggtcagcgaggcattatgttgcgtttcaacaaagtgcatcgtgatgccgataataaagtgattgtgtatgaaccaggtttacactttaaagtgcctgttatcgatcagctaaaaaccttagatgctcgtattcaaacccttgatggacaagaagaccgctttgtcaccgtcgagaaaaaagacttgctggtggactcttatgtgaaatggaaaatcagcgattttggtcaattctatacttcaactggtggcgatacacaaaaagcttcaaccttattacaacgtaaagtcaatgaccgtttacgttcagaaatcggttctcgtacaatcaaggacatcgtttcaggctctcgtggcgagctgatggctggcgctcaaaaagccttaaatgacggcgaagatggtgcagaacgtttagggattgaagtggttgatgtgcgtgtaaaacagatcaacttaccaaatgaagtatctgcgtcaatttatcaacgtatgcaagctgaacgtgctgccgttgctcgtgaacaccgttcacaaggtgaagaaaaagcagaatttattcgtgctgatgttgataaaaaagtggtgctgattttagccaatgcaaataaaaccgccgaagagctgaaaggtcaaggtgatgcagaagcggctaaaatctatgctgaagcatttaaacaagaacctgagttttacagttttgtgcgtagtttgaaggcttacgaagaaagttttgccgcaggctcaaacaatatgatgttgcttaaaccagacagcgaatttttccgctttatgaaagcacctacaaaatagttatatccaaagacccgacaaatcgggtcttttttatctttaaaatagaaagctacaacgaggttgtaaaattttaggttgtaaaattttaggttgttatataacagtttatattaaccaaaatgtagggacacactgagtgtgtccgctcataaaagatcatattgaggacacactcagtgtgtccctacagtatgcctgaaagattgaggtttagcgtaactgtaacaaccaaaaaaaatctaatcgcttgtatgcttttgacattcactaaacctaactaaaagaggcaatttattatgggtaaaagtgttgcaatccttggggctcaatggggcgatgaaggtaaaggcaaaatcgtagatttattaacggatcgtgtgaaatatgtggttcgttaccaaggtggacacaatgcaggtcacaccttaattatcaacggcgaaaaaaccgtacttcgccttattccatcaggtattttgcgtgaaaacgtgacctgcttaatcggcaacggcgtagttctttccccttcagcattaatgcaagaaatgggcgaattagagtcccgtggtattaacgtgcgtgaccgcttaaaaatctctgaggcttgcccactaattttgccatatcacgttgcaatggatcacgctcgtgaagcggcgttaggtaaaaacaaaatcggcacaacgggccgtggtatcggccctgcttacgaagacaaagtcgctcgtcgtggtctgcgtgtcagcgatctattcaaccgtgaagcctttgcggaaaaattaaaaactattttggaatactacaacttccaactggttcactactacaaagttgagccagtcgattaccaaaaaaccttagatgatgtttttgcggtagcagacatcatcacaggtatggttacagatattacaaccctattacacaaagctcgtgccaacggcgacaatatcctatttgaaggtgcgcaaggcacaatgttagacattgaccacggtacttatccatttgtaaccagttcaaataccaccgctggtggtattgcaacaggttctggtttcgggcctcgtaatttagattatgtattaggtatcattaaagcttactgtacccgtgtgggatctggtccatttacgaccgaactgttcgatgaagtcggtgcagaaattgctcgtaaaggtaacgaatttggtgcggtcacaggtcgcccacgtcgttgcggttggtttgatgccgttgctgttcgccgtgcaattcaaattaactcaatctcaggtttctgtatgactaaattagatgtacttgatggctttgaggaattaaaaatctgtgtcgcatacaaattacaaaatggcgaaatcgtagaatactcaccgcttgcggcggcaaactgggaaggggttgaaccgatttatgaaaccttaccaggttggaaagagaatactttccgtgtaactaaattagaagatttaccgcaaaatgcgatcaactacatcaaacgcattgaagaagtgttaggtgtaccagtcgatattctttcaacaggcccagaccgtgttgaaacaatgattttgcgtgatccgtttgcggcgtaattaatacctaaaaattcttgcccaaagaacaagttgctaagttttatatataagacaaagcaacttgttttgtttaaaataaggcatgatttcttcttattgatcttgtcctatgaaaattattgataatattaactctattcttggtgaagatattcgttctcaaataaataattgcaggagttatttttactctaaaatctcgccatacagacaaccaacataacaatccaaatcgcctttacccttattatattgtttatattcaagaaaacggtaaagtagtttatgattacactaaagctaaacacctgttagatattgcccgcaaattcaacgcccattgctgaagcttatgaagcttttaataagcgaacaaaagacggtagagatatgcgtcaacagttacttgatattgtgataaaggaaatccaacaaataaattgaaaacagtcataggtagttattatcgttcaaaatggtttgaagaaaatgaacgttctaacctgccactgtttttacatttagttgatttatatgagcatatcatttctgaattattaccaattaatacagatacattatcatctattgaagagaaattagcattaaataaaaaattggaacagacacatcaagaaataaatcaacttaaaaagaaacttaaagctgaaaagcagttcaatcgtaaagtagagattaatttaaaattaaaagaacttgaaaaacagctttcttatttttgattaaataatattgtttagactaaaagaatatggagtatttatgtccactgaactcaaaatgcacaccgaaaatttggttgcaaaaaatattgaaaaactgaccgctctttttccaaattgcattactgaaatgcgtaatgagcaaggagaaataataaaaggcgtagattttgatttacttcgacaagaactttctgaagtcttagtcgaaggaaatcaagagcgttatcgcttagactgggttggaaaaaaacaggctattttggctgccaatgaacctattgcaaaaactcttcgcccttgcagagaagaaagtgttaattttgataccacacaaaatttatttattgaaggtgataatttagatgccttaaaactgctacaagaaacctatcttggcaaggtaaaaatgatttatattgatccgccttacaatacagggaatgattttatctataacgatgattttgcagaaaattataatgattttttggcaagatctaaccaaattgatgaagaaggtaatcgtctaacagctaatacagaaagcaatggacgttttcactccgattggctatctatgatgtacagtcgtcttaaattagctcgaaatttactgagtgatgatggtgttatttttatttctatagatgataatgaaattcataacttaagaaagattacagatgaaatttttggaagcgataattttattgctgaaataattagaaatacgaatagttcaaaaaatcaaagtttatttgtatctgtaagtcatgaatattgccttacatattcaaaagatattaacatattatccaaattacatagtgataataaatggggagtggaaaagaataaccttaaagagtatctatcttcagttagaacattaaagaataaaggattaacacataatgaaattactgaagaattaaaagaacttactaaatatcctagatttattgattttaccaattactggtattttgatgacactgggttatatcgtaaaggcgatttaggaggagtaaaaaatggtaataaaactcctattataaatcccctaacaggaaaagaggatcctattccacctggtggatttagatattctgaagaaaaattatctatattaattaaagaaaatagaattcactttcataccgatggaagtttaccagctattaaacgttatttacacgaaaatgaaacacagcgtccaaaatcaattatgagcgacgatcaaagaccagattattcattacttcaagaaatgaaattatcttttgataatccaaaacaaatggcatttatgaagcgtattttaagtatttttggaaaagatatgcttgtgatggatttcttcgcaggtagctcaaccactgctcacgcagttatgcaacttaacgccgaagataacggaaatcgccgttttattatggtacaattacctgaaaaaacagacgagaaatcagaagcttataaagctggctattcaactattgccgagatttccaaagaacgcattcgccgtgcaggaaatagaattatcgcagagcagacggatcggatcggatcgccaagattatgctttaataaattcaactccacaactagatattggctttagagtcttaaaaattgactctactaatatgaaggatgtgtattacacacctgataaactttcccaatctctgcttgatcaaatgacttctcatattaaagaagatcgttcggcagaagatctcttatttcaagtgatgcttgactggggcattgagctttccctatccattacgcgtaaaactattgataacgcaacgatctactttgtaggagaaaatagccttgttgcctgttttgatccgcttactcctgagataatcaatgagattgctcaagcgatgcctttacgagtagtctcctgcgaatctgctattattgccgatcacgataaaaccaatattaaagaacggtttaaacaactatcaccagatacagaagtacgttttttataaagggggaataaaatgaaacttcaatttagaaccctaggttatcaacttgcagcagtcaaagcagtggtagattgttttacaggtcaacctaaatcaacaggtcatcgttatcaacgagataaaggcttaaataaaagcactgaaattcaacttagcttaaatatgccatcacaagcgggaagttttgacgaggatatcgcaaatggtgatatcggatttcgtaatgctcctatcactcatttaaacaatgtactgagtaatattcaaaaagtacaaggtgaaagtggtttaacccgttccgataaacttatcactgacgataatggtaaaggcaaaaatttaacttccagccagctcaatattgatattgaaatggaaacaggaaccgggaaaacttattgttatatccgtacaatgtttgaactaaacaaacactatgggtggtcaaaatttattattgtcgtaccaagcattgcgattcgtgaaggtgtagataaaagctttaaactgatggaagaacatttccagcaagaatatggcaaaaaggctcgctgtttcatttatgattcaaaagcattacatcatttggaaaatttcagtgctgatggtggcattaatgtaatgattattaatgtccaagcttttaatgcaacaggtaaggatcaacgccgaatttatgaagaattggacgaatttcaatctcgccgtccgattgatgttattcgcaaaaatcgtccaattttaattttagatgaaccacagaaaatgcaagcggataaaacgttgcaatcattagcaaattttaatccgctatttattttacgttattctgcaacacataaacgtaactataacttagtttatcgtcttgatgctcttgatgcttataaccaaaaattagttaaaaaaattactgtaaagggaattgaagtccaaaatctttctggtacaagcggttatttatatttagaaaatattgaaatttcgaaatctttaccaattgcccgcttagaattagaaatagcaactaaaaatggttttaaacgagaaattcgtaaaatcagtaaaggcgataatttatttgaaattaccaaagcacaacaatatcaccgctatgtggtagaggatattaattttcgagaaagcaccgtgtattttactaatggcgttaaaattcatatcggtgaagcattgggagatgtcaatgagacagctgtgcgaaccattcagattcgtgaaactattcgctcacatttaataaaagaacgccaattattcgatcgtggcattaaggtactaagcctattctttattgatgaagttgccaaatatcgtcaatatgatgaagacaataaccctattgatggtgaatatgttcgtatttttaaagagcaatataagcaagttatcaatgagttttctgaattggatttagatggatacggatattggaactatttgcaaaatattgatgtgaataaaacccataatggctatttttctattgataaaaaatcaaaaagaatggttgatccaagcttagataagaaagctgaagaggcacagatttctaatgatagcgatgcttatgatttgattttgaaggacaaagaacgattactttcctttgaagaacctactcgttttatcttctctcactccgctttgcgtgaagggtgggataaccccaacgtatttaccatttgtactttaaaatattctgataatgttatttcccgccgtcaagaagtcggacgaggattacgtttagcagtgaataataaaggggaacgaatggatgctaaatatttgggagaaaatagccgagaaatacatcaaatcaataacttaactgttgtcacgaatgaaagctataaaacctttgtgaaaaatttacaagcagaaatgctagaagcaatttcaagccgtccgagcaaagcggatgaagcttattttacaggcaaggttattattctcaacgatggcaaaaaacatcaaattagtgaacaagaagcaaaacagatttatcgctatctattaaaaaatgattatattgatgataacgatcagattaccgataactatcatcaagctaagcaggagcaaaattttgcaaaattaccagataatttaaccgcataccaaacacatatatttacattgattgatggagtgttcgatccaaaagcccttgaaggtatggttgaaaacagtagtcaaaaaataatgaatcctattaataaaacaaatctacaacgaaaagaatttcaagcattatggcaacgaatcaatcataaagctgtatttgaaattcagttagatagtgaaaaattaattgctgatagtatatctcaaattacccgaatcgcttgtgaacgggataatcgttttgttgaatcaattagttataaattgggtacaacaacacaaaaagaacaaattgactataatgacttaaaagtaaaagagagttttggggaatatcgtactcaaacagaaaaaacagcaatgtcggcaaactcgcaagttacttatgatttaattggggaagttgccaataaaacgaatctgactcgccgtactattgttgaaattttaaaaggtatcaataatgcaatttttgcacagtataaatataaccctgaggcctttattcgtgaagtcagccgaattattaatgagcaacaagccaatatggtcattcaaaatctgacctatcatccgttgcagcaaggttatcctgacagcgagatttttattagcaatgagataaaaaaagaggcatttaaagctacacgacatatttgggaatatgttccgacagattctgtcattgaaactacgtttgctgaagctttggataatgctagtgaagtcatagtttatgcgaaattaccagacagtttccatattccaacacctttcggcaattacaatcctgactgggcaattgtgtttgagcaacaacaaactcgtcagatttattttatcgctgaaacaaaaggcacaagtgaagaaggcgaactccgttttaatgaatacaataggatcaaaagtgctaaacgtttctttgacatacttaaccaaaatactaccgaacaaaaaatccgctatgatgtagtgagtaattttgatgaattgatgcaaattgttaaataattagacttcaatgaagagcataagctcccaggttcctgctttttttgtataaaacagatcggatctgaccgctcgtttacatttatattgcgaacttagtggcaaagtagtgtaaaatagccaagttttcgtgatttatattcatagaggaaaaagaatgaaaagagtagtcatcacaggtatcggcattatttcgagtatcggtaataacaaagaagaagtattagcttcattaaaagaaggtaaatcaggcattgaatttgtacctaaatttgctgaagtgggtatgcgtagccaaattgcagggacgattaaattaaacccggcagaattaattgaccgtaaagtataccgttttatgggcgatgctgcagcttatgcttacctttcaatgaaagaagcgattgaagattcaggtttaaccgaagagcaagtgtctaacgaccgtaccggtttagttatcggtgcaggcacaggctctgcacatagtcaattagtggcttgtgatgcagtgcgtggtcctcgtggcgtaaaagcagttggtccttatgccgtaactaagacaatggcttcaagtgtatctgcttgcttagcaaccccttataaaattcgtggtgtaaactactctatcagctctgcttgtgcaacctctgcacactgtatcggtcacgcaatggagttaatccaattaggcaaacaagatgtggttttcgcgggtggtgctgaagagctatcttgggaatgtgcaacggaatttgatgcaatgggtgcagtttcaactaaatacaacgaaaccccaactaaagcttctcgtgcttacgatgccaaccgtgacggcttcgtcatcgcaggtggtggtgctgttgttgtggttgaagagcttgaacacgcccttgctcgtggtgcaaaaatttatgcggaaatcgtaggctatggtgtaacatcagacggttacgatatggttgccccaagtggtgaaggtgcggaacgttgtatgaaacaagcgatggcaacagttaaaggcgaaatcgaatacatcaacgtacacggtacatcaacaccagtgggtgatgtgaaagaattaggcgcaatcaaaaatgtctttggcgataaaaccccagcgatttcatcaactaaatcaatgactggtcactcattaggtgcagcaggtgctcacgaagcgatctactcgctattaatgttagataacgatttcattgcaccaagtatcaacattgaagaacttgatgaacaagcacaaggtgtgaatgtcgtgacagaacgccaagacaaagcattaacaaccgtaatgtctaacagcttcggctttggtggtacaaacgcttgcttagttttccaaaaatatcgaggctaatcttgcttaatttttgaaatctgatataggggagtgggaattttcccacgtcttttttatttatttggagtgaataatgttaaagtttaaacatttattatctattttagtattggcagtttcagcaaatgtcgtggcaagcggtgtatcaatggaaatgtttcaaatgaaacgccaaattaacctattaacgaatgcccaaacagctgaagaatttacgcaaaatgccgataaatttattgaagtgtctaaaaaagcccaagcaactatgccaaatagcttagatggcgatcaagagaaattcaaaggctatcaacaaggtatgcaagaagtcatcgatgtggttgctcaagcaaaaaacttagcaagtcaaggtaatttaacggaagcaaaaacagttattgcacgtttagatagcttaagaaaactgtatcattcgacatataaataaacatctagcctaaagttaaatggacgaaaatggtgtaatagacaaatttgttgcaaaaaagcagcttaaaaaaagtctctcccacaaattgtgggagagactcatttattgagaacattaagctatctttctcaataatatcaactagttgcttattcattctctgataggaaataagattacttttatcacgattaaatagtgaattaagtactcgttgagagttaattatttcctcatataaaaaagaattttctaaccgttcaacataatcagcataacttaaaataagttacatttttaccttcttaaattaaacaattttctatttctgatgcattttgttctagctctcttaatacctcgatgaagaattcaagagttttgatcattctaattaattcatccttagaacgttgaattttttccctatacgctggatatccctttgcttttaaggggactatatagttcagcatcatccctcggttttctgctttatcaatttcatctttatatatattaataaaaccatccattttattaatgagtttattaatatcctcaataagtttttctagaatttttatttgacccaaatagttttgtgattcatttgccatagattttcccctctttgactagtttaaagctttctgacattatcagccaatccaccttgtatatgattatttaattgggcttttccccctaatttctctattgcattattggctaatattgcttgagtttgaaagccacttttgtgatttcctaataagaagatagcatctctagttaattcatcaaaatatttccaatgatgctccattgtttgtcgaaaatcattaagcgtattgctgaaaattgcactattaatagcagcccttagatcatcaattgcctttttatttaatttatgccaagtatctattccctcacaaaaattgttacaacaatcaatctggttttgtagagattgcaaattattaaaactcattatttttttctccattatttagaatgtcatttactttatttttttacgttattacgtaatttcttaattgggtctaatcctccacctttattaccactattgttgatatcaaagcttggattttctaatgggcgagatgatgatttctcaatacgagattcatctaaaaaatctcctctcccttgattatctaaatttatcaaaatatttatcccaatctgtatcaactggaggaatgttttctgcagattctgattcttttaaaaagatatcatttttctctttattaatttcactattaaagaaattaataacatcattcttatcgtctagaaccgatattgaagaacttattgaattatctgatagactgctatgcattgaaatatcatctctcgttatcgtattaatcacaatacattcgtaatctcttcctctatattgttcaataacctcttgaatcattaaatcatctgcaggtttattcattaaaatacgttgattattttccttgactcccattccatcgtttaaaataaactgaaatggttttagataaacaggtgcttcattacctatcataaagattttcattgaatctgatgtattaacagtaaaagcaatacgcattttaaattgtgttaataattcagaacttattgtatagcctgttagtgtctgcgtagacataatcatatgcaatccaaaggctcttccccgtttagccaaatcaatcaataatttctctattttcgaagatttaggatgctcaaataaacattgcacttcatcaataattaaataacttcgacttaactgtgagtctgtagataatttattatattgatctatatttttaacattttttgcttaaataatattcctctttcttttatcaaattagagaatttctgcaatgcatcaataactggatcaacttgtgaattatttaacatcaagactcggatatgcggtaatcctaggtacttctgaaattctacaccttctttataatcaaataggtaaagttccgcttgctctggtgtaaactgagaaacaattcctttaataatatgatctagcagtgttgtttttcccgtgccattcataccgaccataaatgcgtgataggcttgacttcttgctcctaattcaaagtaacatttctctttaccatttggtgttaccccaacctcaatttctaagaatgcttttggtttagatgcttgactaattctatactcttcttttaaattgtttacaacttgattaaagatgtgcttaaccccatctcgttgagataattcaatagtaagtttattatttttgatcagtgtgcttaatttattaaatagatgggaattttcttgaagaaatatatcttttccgattaattctaaacttggtatctgactaagtaatttagtcattctatcacctagtgcctttctttttttatcatcatcaccatttttgagataatggttaaattcttcattgtcaaaataaaaaataaacttaactcctgctgaatatgctgaagcaataatagtgtttagaaaatctaatctatcatttgataccgcataatcattcaaattaataatatttaatatgtaattttcttgtgcccttggatcaacttgttcattatattgataaattgaagtaatattatcatcaattaaattataagatcgctcacgaactaacgaagctaaccattgattaaatttattaatggcatcatcactaaatattgaaatatttttttgctcattaagtcgcataatatttggaaatatgttatataacgacttatcaataatattaattttaggtacttgataacgtattaagcctaaaagaaaatgagcggaaatatcttcacaaagatgggccacattctgcttatccttctctgtatagtgaataagcaaactatgactatcgctaggaatcaccgcaggatagagttgccctctggtcgggtggcgtaattcaccaatgtaaattccccaaggataatgggttccttgaattgcaatatctgtttgaataagctgttcttgcattgctaacctcggtctataactcatttatgctaatttacaattattttgtataaatctgatactatataaccaaattgtacaaaaaaacaactgtgcaatctttaagagaatatattagataattaaatctaagtgttctctaaccaattgtttttaatgaaaattaaacattttaatgtttaaaattaagagattttacaaatgatgtgtataatgcggagaccttataatgtaaaagcccttatcttagttataaaccgtaataacagccttaaataattgcaaaattcaaatctttgtacaactgttacagcatcctattacttgctcaaccccaaaaggaaaataaaatgacaacaatcacattacaacttgacggcttacattgcggcaactgcgtgaaaagtgtagataaagcattacgagaattaccaacagtaagcgacgtgaaaattgatttagcaacccaaattgctgttatcgacggtgaagaacaagcaaaaaccttgattgatgccattgttgatattggctttgaagcaaaagaggcataatctaatggctcaagagcaacaatttttgctcaatggcttacattgtgcatcttgtgttcgccgtgtggaaacggttatcggacgattgacaaacgtggaatatgtgtcagtcaatttagctgatcaaactgcctttgtacaaggtaaggtcacggctgatgcggtagtacaagcggtgacaaaaatcggtttcggtgcagaattgctagaaagcgaagaaattcgtcgggcaaagcagcaagcccaaactgcagcagccttaacccagaagcgtcgtcaatttactgttgcattagcggttggggtaatgttaatggcatacggaatgtggttcggtacgtcgccaactgtagaaaatcgtccgctttggtttgcttgggcggtcatcaccgccagcactatgttttttagcggcaaacacttttttacaggggcgtggacaagtctaaaacatcgtgcagccacgatggacaccttaattgcaattagcacaggcgttgcctttctttattcgctgtatttaacgctatttcctcaatcccattcccatttgtactatgaagccagtgtgatgatcatcggctttctcaatctaggaaaatatcttgagttaaaagtaaaacagcgttcatcgcttgccttagaaaaattgctggatttagcaccgcagcaagcggttgtttttgacggagaaattacaaaaaccatttcaactaaaggtatcaaaccacagatgcggattcaggctctgacaggagacagatttgccgtggacggcgtgttgcagagcggttcattatgggtagatgaatcaatgctcacaggcgaagcgttacctgttgagaaacgagtaggcgataaagtgcgagctggaaccattgttcaagatggtgctggtatttatcttgccgagcaagtgggttcgcaaactgcactagctcggattatttccgcagtccgtcatgcacaatcctctaaaccaccattagcacaatgggtcgataaggttgcgacggtgtttgtgcctattgtggtgagtattgccttgttcagtgcattagtttggttggcattaggtcaggattttgcctttgcattatctattttcacaacagttttaatcatcgcttgcccttgtgccttaggattggctattccactttccaccattgcaggggtcgctcgttcggctgaattgggtgtattagtaagaaatattgaagcactacaagcgagtagtgaaattgatactttggtgtttgacaaaacaggaacccttaccactggcgaaatgcaggttacacagattaacactttaggcaatgtatctgctgacgaagcactacgtttagccaaaagccttgaacagcaaacggctcacccgattgctaaagcgattgtaaaatatcaccctgatctgaccgcttatcctgcgagtaacataaaagttgccaaaggtttagggatttcagctcaagtgggagaaaacaatgtaaaagtaggcaatcggcaatttgttgcttctgacttttgtgaagagcaagatttgactacgcaagttttcgtttcactcaatgaacagctcattggcgtgatctatttgcaagatcaacttcgccctgaaagccaagcggttattacacaatttaaacagcagggctatcgctgcataatgctcacaggcgaccgccaagctacagcaaactattatgccgaaacattgggtttagatgaagtgattgcagaagtgttgccggagcagaaagctgaacaaataacgaagttacagcagcaagggcggaaggtggcaatgatcggtgatgggatcaatgattctcccgcattagctcaagcgaatgtcggtgttgcaatgtacaatggtagtgaaattgcgatagaaactgcggatctctcattaatgcaatcgggattacaaccactagcagcaattttgcccttctcaaaacaggttgtacagaatatgaaacagagcctagtcggtgcctttatttacaatatcattgccattccgattgcttgcggtgtactttatccttttactggctggttattaaacccgatgattgcggcagttgctatggctttgtcgtctgtgactgttgtgttaaatagtcagaggttgttaagataaaagtacaaaatagagagcaaaaaagaattctatttaccatcgtgttattaccagccccaaccattcaaggagtgatagaggatcactatttgggtgtctgcgttactgttagattcatctatttcagtatttgtgagtaatgttattatgctgaagcataacaatcttattttattgcttacagctccgtgccgtaaaactccgctatttttgtctactatacctttttgttcacatccaacaaaaaagagaaataaaaaagccttgaagtttttacatttcaaggctttatattatgtttgtctagatctgctgaaatcaatttggtggagataatcgggatcgaaccgacgacctcttgaatgccattcaagcgctctcccaactgagctatatccccaaaattgcgagaaatgatatgctctcgctttttttctgtcaatctgaaaacaatggaaatagattaattgattaaaaactaactagttctgcgcttcaataaacgcaatcgctttttgaatacgcgcaagcgttctctctttaccaactaacttcgcagtaatatccatagatggcgactgccctgagcctgttactgcaaggcggaatggcatacccactttacccataccgatgtcaagctctgcggcagtttggttcattgcatcgtggatattttcaacactccaatcatcacaagcggtcagtttttccaataatttcgcaagtggtgcaactgcttctgctttgaagtttttcgctaccgctttttcatcatagctatcaaattcttgatagaaataacggctttggcttgctaattcttttaaggtttttgcacgttcgcttaagactggaatgatctctgctaatgcagctccttgagagaaatcaatcccctgagcattcatatgccattcaaggtattttgcgacatagtctgcaggcaaactacgcatataatgttgatttaaccactgcaatttttcagtgttaaaggcacttgccgatttgcttacagaatgaatatcgaataattcgatcatctcttcacgagtaaagatctcttggtcgccgtgtccccagcctaaacgcacaagatagttaattaaggcttccggtaaatagccatcatcacgatattgcattacgctgactgcaccgtgacgtttagagagtttctgaccatcatcgccgttaatcatcgaaacgtgcgcgtaagttggaatttctgctcctaacgcttttaagatgttgatttggcgtggtgtgttgttgatatgatcttcgccacggacaacatgggtaatgcccatatcccagtcatctacaaccacacagaagttgtaggtcggtgcaccatcggtacggcggataattaagtcgtctaattcgctgttgctgatttcaatgcgtccacgcacggcatcatcaaagaccactgagccttctgttggatttttaaaacgaacaacgtgcggttcgcttggatcgtgtgaatgatcgcctaagcaatggcggtcataacgaggtttctctttatttgcttcttggtttgcacgtaattcgtctaaacgctctttggaacaatagcagcggtatgctgtgccttcttcaatcatttgatcgatcacttggttataacgatcaaaacgttttgtttggaaataaggaccgtgttcccacgccaagttaagccattccattccttcaatgatcgcagcggttgcttcgggggtagaacgctcaaggtcagtatcttcaatgcgtaatacaaattcgccgttgttatgtttagtatacaaccaagaataaagtgcggttcttgcgccaccaacgtgtaaatagcctgtcgggcttggtgcgaaacgagtacgcacttttacattcggatctaaagggaaaagggtttcaattttcatattatcgcctatatttttttgattttgataaacaaaaagatttcggtattttacccctcttgagcggaaatcctagtagaaaatcagcaatttgggcgaaaaattcaacgaacaagtaaaaaatagcaaaaatggattgactgaaaatttttgaactctataatgcgaccccacaacgacgggcgattagctcagttgggagagcacctcccttacaaggagggggtcactggttcgagaccggtatcgcccaccacttcaacttttgaagtccgttgttacaatctaatttagtttgaaaagggcgattagctcagttgggagagcacctcccttacaaggagggggtcactggttcgagaccagtatcgcccaccacttttttaaagtaccaacctttcaaacttcccattagtttaaatgcttatcttaagtgggcgattagctcagttgggagagcacctcccttacaaggagggggtcactggttcgagaccggtatcgcccaccacttaatccaagtgtttaaactagtcgaaaccgcaaggtattcgggcgattagctcagttgggagagcacctcccttacaaggagggggtcactggttcgagaccggtatcgcccaccacttacttttcatcaatcactttattttacaaactttttgtcttatctagccgcttgtttttaactttattactattttttcgatctctgtcgaaaaatttatctcttgttctttcccttttttgtatttcgattaggctttttctgtttttccataaactatacgttttaaacgtatatttaacttaaaaataggagtagaataatgaatgtcacttttgtggaattaccgccttttgaggaatatagaaaaaagtatcttgacgatgacacatttagattattacaaaatgagttattaaaatttcccgataagggagagcttattcaaggtactgggggactaagaaaattgcgtattgtagatattattagacaaaaaggaaaaagaggcggagctagggtaatctattactattatgtgcaagggaaacaagtttagttgttccacgcctacaataaaaaccaacaagacgatttatctaatgaagaacgtgtggttttggcgaatacattaagctatttaaaatctttagtgaggtaatatatgggaaaattatttaatgaactaatggaagggatgcaagcattagagttgcatttaaaaggcaaaatcacactaaaaaccactgtcgtagaagttcccgatccgatagtaattacccctgaagaagtgaaagccattcgccaaaaattaaatctttcacaagcggttttattattaaaaatggttgagaaatcaccaaaaacatttgagcaaattgcgagcatttaagtgaatatcggcttgtttatcgcaagccgaactatttttgtgatccccgtcgaaaaattcattatttcaacttttcaaatcttgtaaaaatcactagcctaaatgagcagacaacagtagaattgccacctttaatttaactaaattccagcaaaactaaccttttgccacaaaccgtgtaacaacgaggctttcaaacaatgtctgaacaaattcaagcaaccgatgcaagttgcaattcaaccaaaactgaaaaaattaacttattaaacttaaaccgtcagcagatgcgtgaactgtttgcggaaatgggcgagaaaccatttcgtgctgatcagctgatgaaatggatttatcattttggtgaagataattttgataatatgaccaacatcaataaggtgttgcgtgaaaaattaaaacggatcgctgagattaaagcacctgaagttgccgtagaacaacgttctgccgacggcacaatcaaatgggcgatgtgggttggcgatcagcaaattgaaacggtatatatcccagaagatgatcgtgccaccttgtgtgtttcttcgcaggtgggttgtgccttggcttgtactttctgttcaacggcacagcaaggctttaaccgtaatttaagcgtatctgaaattatcgggcaggtgtggcgtgcatcaaaaattatcggtaactttggtgtaacgggcattcgtccgattaccaatgtggtgatgatgggaatgggtgaaccattgttgaatatgaataacgttattccagcaatggaaattatgttagatgattttgcttatggtctatctaaacgccgtgtgactctttcaacatcaggggttgtaccagcgttagataaaatgcgtgagcagattgatgttgcattagcgatttcattgcacgcaccaaacgatgaactgcgtaatgaattaattccactgaataaaaaatacaacattaaaacgttaattgattcagtgaataaatacttagaagtatcaaacgctaatcacggtaaagtgacgattgaatatgtgatgctaagccacgtcaatgatgatgtggaacacgctcatcagttggcagatgtattgaaaaataccccaagtaaaatcaacttgatcccgtggaacccgttcccagaagcaccttatgcgaagagttcaaatacgcgtattgatcgcttccaaaaaaccttgatggaatatggctttacggtgacagtgcgtaaaactcgtggtgatgatattgatgctgcctgtgggcaacttgcaggtgatgtgattgaccgcactaaacgcacctttgaaaaacgtaaattcggcgaagggattgcggttcaaaatcagtagtatatttcaaggtagagacacactgcgtgtgtccgttccaacaatcgtaattcgtatcggcggacacacgcggtgtgtccctacatagagggaagtcaaatgacctttgcaaaatttttccgtaatttgaccgcttgtagcgtggcattatggcttgttgcttgtgcgaaccaaactactcaggtggattttaaccgctcggaagccgtcaaagctcgcattaatttggcccttgcttaccttgaacaatctgattttccaaaagcgaaagagaacattgacaaagcgcttgaacacgatgtaaaagactacctaccgcactctgtgcttgcctattattaccaacaaactggcgataaccaaaaagcagaagaagcctaccagcaagccttgaagttaagtaaaacacagagcaaaaacaatcaagttcgccctgatgtattgaataactacggtacctttctgtgcaaacaaaaacagttcgacaaagcctatcagcaatttgaaacggcattaaccagtcaagaagcctattacaatcaagcagatacactagaaaatatcgccttatgtgccaatatgaagaaggatattgagaagcaaaaaacagcactatctcaacttgagaaaatagataaatcaagagcagaacgactatataatttcatggagattagataggcttattttcttaaactagcgtataattcgctcaatattttattttagctaggatatgttatgaaccatcttccaattgcaaatgaagctctacatctttatacacaagctatttctcgcctcaatcaacacttatctgaagcctttaatcaagccgttgatatgatattaaactgcgaaggacgagttgtagttgcaggtattggtaagtcaggattagttggtaagaaaatggttgcaacctttgcttcaacaggcacaccaagtttctttttacacccaacggaagcctttcacggcgatttaggtatgttgaaaccgattgatgtagtgattttaatctcttacagcggtgaaactgatgatgtaaataaactgattccaagtttgaaaaattttgggaataagattattgcaatgacgggaaatctgcaatcaacattggctcgtcacgcagatataacccttgatattagtattgagcgtgaggcctgtccaaataatcttgccccgacgacctcaagtttagtgactatggcattgggcgatgtcttagcgattgctctgattaaagctcgagattttaaagcggaagactttgctcgtttccaccctggtggcagccttggtagaaagttgctttgtcgtgtgcgtgatgttatgcagaaaaaattgcctattatctgtccgctttgcagttttagcgattgcttgaatgtaatgaatgaaggacgaatgggggtagctattgttatggaaaatgagcaattgcagggtattattaccgatggtgatattcgtcgtacacttgctaaatttggtgcagaaagcctaaataaaactgctcaagagattatgagccgtaatccaaaaacgattttagatagcactttccttgctcacgcagaagagtatatgaaagagaaacacattcactcgttaatagcggtaaatgaagcaggaaaagttacgggcattgtggagtttgcaagctaatggcaaaatcaaattacataactcgttctggttggcaagtattagaccaagagttgaaatatctttggaaagatgaacgaccaaaggtcacacaagcggtatctgaggctgcggcattaggtgatcgtagtgaaaatgcggaatatatttatggtaaacgccgtttgcgtgaaattgatcgccgtgtacgttttttatcaaaacgtttagaagtgctacaaattgtcgattaccaccctactcaagaaggcaaagtctttttcggtgcttgggttgaactagaaaatgaagagggtgaaatcaagcagtatcggattgtgggctgtgatgaatttgatcctgcaaaacaatggatttcgattgattcccccgttgcaagagcattaattggcaaacaaattgatgatgaaattcaagttgaaactcctgttggaaaagtgacgctctatatcaataaaatttggtatgaaaaaaactaaccctatgaaaagtttagcctttatgtaagaaatgttataaattcaccgttttgattagtaactaggcaagcggtctgtaattttaatttttttgcaaaaataatttgacatatttccagaacctagtaatatgcacgcccacagacacagtgagtggtgagatggccgagcaggctgaaggcgctcccctgctaagggagtatggggttaaaaagctccatcgagggttcgaatccctctctcaccgccatttactttatcacgcacccgtagctcagctggatagagtactcggctacgaaccgagcggtcagaggttcgaatcctctcgggtgcgccattttatttttatctatcaggataaaatggtcgctgataaaataaataacaccgtttcttttcaaatacgcacccgtagctcagctggatagagtactcggctacgaaccgagcggtcagaggttcgaatcctctcgggtgcgccatttcaaattaacttcctaatttcatttagtgtcattaaaacggtttttatgctgacttttgcacatcaagaacatattcgcacatactattccgatactcgtaatattcattttcaattacctcatctttcaagcaatcaatctacggacgtttgcgtaattggtgcaggctttttagggctttcaaccgcattggagctagcagaaaaaggtaagaatgtgattgttgttgagggtgcaagggttgggtatggtgcatcgggacgtaatggtggacaagcaatcaacggttttgaagaagggattgatgagtatattgaacaagttggcgaagaaaatgctcgtaaactttggaatatgtcccttgaggcgatcaacattattgacgagcgtgtcaaaacctacaacattcaatgtgactggaagaaaggatatgcaacgcttgcgttaaatcatcgtcgaatggacgatttagttgcaattgaaaaagagagccgtgaacgctttggctatcaacatatgcaactatgggatagggcaaagttagaacagcatttaggcagtaaaatttattgtggggcgttatacgatagtcaatctggacatttacacccattaaattattgtctagggttagcggcagcctgtttagagcaaggagtcatcatttacgaacacactccagcccttgatctacaattttcagataaacaagttaaagttattaccccacaaggtactattaccgcagataacgtcatattggcaacaaatgcttatatcgacgctaaatctaataagaaaattggttttaaacttgcacgcaaaattctccctgtggagagttttatcattgcgactgagccattaactcaagcaatggcggatagtgttatcaataatggtatgtctgtctgcgataacaatattttgctcgattattaccgcttgagtgcggataatcgcttactctttggtagtgactccagttctaatgttgatatgatggcaaaaatgcgtcgcaatatgcttgatgtgttccctcagcttgaagatgtcaaaattgattatggttggggtggtccgattgatatgacattaaatgcctctccccactttggtcgagtgaaacctaatgtttattttgctcacggcttttcaggtcacggtgttgcattaacaggacttgctggtcgtattatcgctgaagccattgaaggcaatgacgaacgcttgcgtatttttgaagccctgaaagtgccaagtttatttggtggaaagcttgtcaaacaaatggcacttaaaattggggtgaattattatcgttttttggatcgatatagataggatagagcatagtagacaaacttcaggaatactgtcaatactatgcctagccaagttatatcaaaagtatacttaaaaacatctaactaatgtttcgcgtgtgcgacactatttaataatttatccgtataagccacgccaatcgccgataaaataaagccgatatggattaataattgccacatcattgtttcagggcttaactttgcagcgttgataaatgtttgcagtaagtgaatagatgaaatactgataatcgccattgagagcttcacttttagcacagaagcattcacgtgatcgagccattccggctggtctgggtggttatcaacatttaagcgtgatacaaaggtttcatatcccccgacaatcaccataattaataggtttgcaatcattaccacgtcaataagatttaacactgctagcataatagtgttttcgtccatcacaccgagattaaccactaaattccataaggattttaagaatttataggcataaatcccttgtaccacaattaaacctaaataaataggaagttgtaaccaacggcttgcaaagataattttgctaaaaatactttgttttaactgaatgttttttaatgtattcatagttgtttctcaataaaataaaagcggtgagattctaacaattttttgcaaaaaaattaacaaacctaaccgcttgaagaaggggaaattatttacggaattgctttccgtcattccacgacaccgtatattctgttggtaagcggacgcttggtaaggctggcacagccgctttgccaatcgctaataacatcactggggcataacgttctctgtcaatttctaggacttctaacactgccttacgatcaaaaataccaatagcgtggctatcgtaacctttctctttgacaactaacattagctgcattgccgctaaactcgtatcaatcaacacttgatctcgaatatcctgtgggctgagtgtattgtgtacgcccattaagaaattaaaggaattttcgcgaaaattttggtgtaaacagccgcttgcaatagaatgatctaacacatcgccaagtaacttttcataatgaagatccgccaaaatgacgactaccgctgaagcactttcacaaggcggtgcgttaaaggcgactttatccaacagtttctgtttttgttctgcctgatccaatatcacaaaccgccacggttgaagattggcttttgatggagcaagctgggcaagttcgatcatttcggtgagttcttcacggctaatctgaacttgattattgaacatttttattgttttgcgttgtttgatgacatcaataagttgcataacatctcctttttaatttgcccaagcctctggggtgaggcgtttgccaaaatggctttcgattaaacgtattgtgattgggtgttgagggttcaatagcacttctttggtactgccatattcgaccacttcaccttgatccattaccatcaatttatctgcgatatgcttaatcataccgagattctgtccaacatagatataggataatcctaaacgttcctgtaaatttaacattaggttagttaattgtgttttcaccgaaaagtctaaggcactgagtgtgtcgtcaatgatgataatttcaggattgagaatcaacgctcttgctaatgcaatccgctgtttttggctacttgatgcctcttttatatgaatcaaggcgtgttcaggatacaaaccaactaattttaaggttttaaatatccgttcgttacgtttttcttcagaaagatgggtagcaagtttcagtggcgaatccaaaatctgcccgatattataattgggatcaaaggcatcatttggatcttggaaaatcattctaatcttcttcgctcgaaaagcgtagtcaccgtaggtcaattcgtgatctttgaaaaacattttgcccgacgttggttcagtaatacctacgagcattttggctaaggtggatttccccgctccgttcgccccgataatcgcaagggtttcttggtgatataagctaaaggaaacattttttaccgcataaaaatcttgcttacggaaaatgccaatgcgatcagtaaagcgtttactgacggactgaatatcgagaagtggaagtgccatagttattttgaaaggctaagaaataatcccttccgccgtttacggggtaaggttagggtggggggaattacaacgatgttacaaaattttcgtttaaattaattgcccccttccgccttcggcaccttcccccgtaaacgggggaagggaaacgaaaagctatatttaaaaattacaatacatctacacaatttaagtcaatgaaagattgctctaagcgtttagacatagactcttccattttgcgtaaccaaacgcgtggatcgtagtattttttgtttggtgaatcagggccttctgggttacctaattgaccttgtaagtaatctttgtttgcattgtagtaatctaaaatacccgcccaagatgcccattgtgtatctgtgtcgatattcattttgattgcaccgtagccaattgcttcacggatctcttcttgtgaagaacctgaaccgccgtggaatacgaagtcgattgatttcgcaggtaagccacgctctttagatacgaactcttgtgatgcacctaagatagatggttttaattttacgttacctggtttgtaaacaccgtgtacgttaccgaacgctgctgcaacagtgaaacgtggacttactgggtttaatgaatcgtaaacgaataacacatcttctggttgtgtatataaacgtgactcatcaacatcgctgttatctacgccatcttcttcaccaccagtgataccgatttcgatttcaagggtcataccgattttgctcatacgctctaagtattttttgcaaatttccatattttcttcgattggctcttctgaaagatcaatcatatgtgaagagaataatggacgacctgtttcagcgaagtgtttttcacctgcgtctaacataccgtcaatccacggaagtagttttttcgcagcgtggtctgtgtgaagaataacgggcacaccgtactctttcgctaattcgtgaacgtgttttgcacctgcaactgcacctaatacatctgcacgagcaccacttgctggtttgatacctttaccagcgtagaattgagcaccaccatttgagaattgcacgataactggtgctttaacgcgtgctgcagtctctaatactgcgtttactgagtctgaacctacgcagtttaccgcaggaagtgcgaagttgtgttcttttgcataagcaaagattttttgtacgtcatcacctgttacaacacctggttttacgatgtctaataattttgccattttgatttaccctcaataattcacaatttgtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttagcgttattggtttcggttttggtctttttctgatgggaaaaaccaatcacgaaattgcgtttagcaacatcaataccacaataaatcggagcgttcatcggtaacctgccttgtattcgggtttatatttcaactgttcggttttgctgatgaagttatccacgcctacgctacagaacgagttttagctctagggacacccaagctgtggataacgttatggtttatgttgctagtttactataattttaatatacaagggacacactgcgtgtgtccagtcaggatttaagtagcggacacacgcagtgtgtccctacgagaatgtttaattaaccgtttgcacgtttctctaaaatttcaaccgctggtaagattttgccttctacgaactctaagaacgcaccaccacctgttgagatgtaagagattttatctgcgataccaaacatatcaattgctgctaatgtgtcaccgccacctgcgattgagaatgcaccatttgctgtcgcatcaacgatagcttgagcaaccacttctgtacctttacggaagttagggaactcaaatacaccaactgggccattccaaaggatggttttcgcattgcggataatttctgctaactcttctgctgatttatcgccgatgtcaaagatggattcttctgcagccacttcgtttactgatttatgcgttgccgcagcagcgtcagagaactctaaaccaacacgcacatcaactggcacaggaatgtttgttgctttagataaacgttgtgcttcaggaattaaatccgcttcgtataatgatttacctacattgttgccttctgctgcaatgaacgtatttgcgataccaccgcccacgattaattggtcagcgatttttgaaaggctgtctaatacagtcaatttagttgaaacttttgaaccacccacaattgctaacattggacgttgtggctcttttaatgctttacctaaagcatctaattctgctgcaagtaatgggcctgcacaagcaactggtgcgtattctgctacgccgtaagttgagccttccgcacggtgagctgtaccgaatgcgtccattacaaacacatcacaaagtgttgcatattttttcgctaactcaggatcgtttttcttctcacctttgttaatacgcacgttttcaagcaccacgatttcgttttcttttacatcaacgccatctaagtaatcacgcactaaacgaacaggaacacctaaatctgaagcatttaaataatcaaccacaggttgtaaagagtttgcttcttcaaatacgccttcggttggacgacctaagtgcgacgtcaccatcactttagcccctttttgtaaggctaattttaaggttgggattgttgcacggatacgagcgtctgatgtgactttgccatctttaactggcacgttaaggtctgcacgaatgaaaaggcgtttgcctgctaggtcaagatctgccattttttttacggacatagttagttcctcttttgattttcaaaaataaaaaacggggcgattatatcagtttcaattatattttgggtaatgtagatcaaattattcgttgatattatgaatttcttcataaaataaaataattatgttctttggtatgatctatttagaaacattcaaacccaagcaaatactatctattctttaatatgcaaaaagcggtcgtaaaacgaccgcttataagagagtaagatgattataaccagaagagataacctaccgttgcaatcacaaaaatacagataatgttcagccagaaaccagctttcaccatctcactctgtttaatttgccctgtaccaaatacaatcgcatttggcggtgttgcaactggtaacataaaggcacaagacgcacctaagccgataattaatgcaagccctactggcggcatatttaaggcttgagcaatagaaataaagattggtactaataatgcagcacttgctgtattagaggtaaattctgttaagaaaataatgaatgcggcaaccagtaatccgataaggtagaagtgtccgccttcaattaagaatacgataccatctgccattactttactagcccctgtttgacctagcactgagcttaaggttaaaccaccaccgaaaagcattaataccccccattcggtatttttctgaatatcgtcccacgaagcaactctagtgatacaaattaagactgcagcaaaaagagcaacgatactgtcgaaactaccaattttaccttgtagccctaataagccagaaattagtgggttaattttatcgccaaatacccaacaaattgcgataacgccaaagatagaaagggtaataatacgctcgcgatttaactcaattttttcaaaactatgctcaaaagtaacatcaaatttcggtttaaataccacatatagcgttgcgatcattaatggcatcaagataaacataatcggcaagccatattttaaccaatctgcaaaagttaaattcagctgtgatgccacaatcgcatttggtggactaccaaccaacgtccccattccaccaatacttgcactataagcaatccctaataatacaaagacataggtgttgtggtgagtttctttatctaatttacttaaaatccccattgcaagcggtaacatcattgctgcggttgctgtattactcatccacattgaaagaaatgcagtaacagagaataggtaaatcaccgcaacggataattttccttttgccattgccataattttatttgcaatcaggcgatcaagctgttgaatgtgtaatgctgtagctaaagcaaaaccaccaaagaaaaggaagatagttggatcagcaaaagcacttaaggcttctttagattttactacccctagaccaatcgccagaacaggcacaagtagagccgttactgtaacgtgtagagcttccgtaagccataaaactgcaacaaatactaataaggctaaacctttacttacagtgggttcaaaaggtaatgtatttaataagacaaagaataaaacaatatcaaataacagaataagtccattccttgttattgggtttgatgattgatgtgataccgacataaagcccccacaaaataaaatgatgtagatcaataaaccagattagtttatcaaaacagtaatttattaaaataagcaaatgttggatttgtgagttatatcacaattttttaacaaaaagaaaggtaggctcttgcctaccttagaaaagattatttggtatattaccgcttgttactgagttgatcttctctcgcttgctcttttttcaccaactgcaacgtctgacgaatttcacgtttactttgccaaactaacagaccgacagaaagaaaagtaattccataagagagccatacatagaagccgtaaccgcccattgagaaaaaatcactgagtgatgcaaattgaaaggtcatattttctcctatttacttaattttgcgagttcacgcacccaagggcgtttgcgttcatcttgaagtaatgcactgcgataacgcacaatgcttaaccaaatcataaagatcattgagccaaaaatcgccaataataatgggattaacatttcggttgccattgaaggcttatcaaatttagtgatggttgccccttggtgtagcgtgttccaccattccacagagaagtggataatcggtaagttgattacgcctaccattgaaagtacaccagccgcttttgcacccgtatttttatcttggaaagctgaatagagtgccattacgccaagatagagaaaaaatagtactaaggcagaggttaaacgtgcgtcccatacccaccaagttccccacatcggcttgccccaaattgctcctgtcacaagagaaaggaaggcaaagaccattccaatcggtgccattgagatcattgccagatgtgcttgacgaatttgccataccgctgcaatgagtgcaacaactgccattgagccataaacacccatcgaccaaattgccgctggaacgtgaatgaaaataatgcgatagctatcgccttgttgataatcttttggggcgaatgccaagccaataataaatgctgctgaaagcaataaaaaacttaagactgcaagccaaggctgcaccttccctagcaaatggtactgtgtttcagactttgcgtaagggtgtaaccatttccacataaaaactccaagttattacaaaaaatagggttcaaattaccgcttgttactgtaaactaacccttaacgcccctgcgattgcaaaaggcgaaaaggttaatgcgagggctaacattgcccctaaaatagcaagttgccctgtatatcccatatttaaggttgaggcttctaacacggcagcggcgaagatcaatacaggtagaaagagcggtaagatcaataaactgagtagcgtaccaccttttctcaacccgacagttaatccaaccccgattgccccaaggcaacttaaaatcggtgtacctaacaatagggttaaaaccaatgcccaccacacttctgtttcaagagaaagcaaaatcgccgtaatcggcgaaagcagaattaaaggcaagccagttaatagccaatgtgcaatcacttttgctaacgccacttgcggcaaaccgacgggtagcaacatcaactgctctaatgagccatctaaataatcatcacgaaatagtcgctcaaaagagagcaaggctgaaagcaccgccgcaacccacgcagttccagaggctattttagcgagtaattcaggattagggcccattaaaagcggaaacattgtgataataatcaagaaaaaccataaagggtttaaaatttccgcaggtttacgaaaggcgatggttaattctcgttggataatagtcagtaaaatcatagggttattttatactctaaatggatctaacgataacacttgaactttgtcactttctgcggtttgatggctggtaaaaatcaccatacccccttgctcacaatgttgttcgatatgggcgatcagttccgcaaccccttttttatcaatcgcagtaaaaggctcatctaaaatccataacgtcgctttggtcagccataattttgccagagccactcgacgttgctgcccagccgacaaatgcgagcaaggcaaatcttctcgcccaatcaacgacacttttcctaaggcattccaaagggcttcatcatctaaaggcaacccttgaattttttggaaaaaacgcagattttcccaagcggtcagttcaggcttaacccctgcgtgatgccctaaataaaagagattagtgtagtattgatctcgttgttgctgaattttaacaccattccactgcacctcgccttctgccgccactgcaaacccagctaaaatccgcaatagactggtttttccaatgccattatgcccttcgatttgccaccattgaccactcgaaatagtcaatgaacagccttcaaacaagcgagtttcaccacgttcacaagcaatattaatgagcgaaagttgatccatttatagtcctaaaatttctttgacaaaaggaagtgtgagcttacgttgagcctgtaacgaggcgtgatctaacaacattaatttatgcattagggcttgtaaatcacgatctaaccgcttgagtaaaaagttcgccacttcatctgaaagctctagccccttattgcgtgcattacgttgcaaaataatgcgtttctgttcatcatcaagatccgccaaacgatatacctcgccccaagttaagcgagaacgcaggtcaggcaagtgaatagctaattgatgtggcggacaatcggcactgattaacaataatgttttcttaccttgattaaacaacccttgctgttcacgaatctgattaaacagatcgaaaatagccaattcccactcttcatcacctgccaccgcttgtatatcatcaagacaaaccacatcaagttgatccccattatccaataccgtaggggcgaagtaatgggatttatccaatggaatataggttgctgattgttgattaagcaaataatgattactcaccgccttgagtaaatggctcttgccactgctcttaccgccccagatataaaaaaaaggttgctgaacatccacaaaattttggcgtagcgaccccaacagcaataaactgttttcggcgtaaaagttgtcaaaagtatcatcatcaatttgatggatcggtaatgtcagttgcaatgtgttatctaagaaaaaaatttttgccaaggatagcggaaaaacgaaaggttgagaagtctcaacctttgatttataagagattttatttattaggctttttgtagttttgtccagttataatacccataaagggaatttaataaatatgcagaatacattatgtacattgatggattttcagcccaaagaacgatagagagaatatttaaggcaatccataatagccactgttcacgataacgtagtaacattaatgcttgagccgcaaccacaataattgtagttaaaccgtctaatcctgttgaactaccgccagcggccttcaaggcttgaactaataataatgttccaataaccataaaagttaataatccagtccatcccttaatagttaatgcttttgtgatcaccgcctcacttccttcggctttttgcatattttgtttccaaaggaaatagcctataaattgcgcagggatataaacatagagcgttgtattcatttcaccaaggaaatttgccccccatgcaacgtagaaatagctgtatgcaaaaattaaaccaaagaaataattactgatttttcctttaccaacaaaaacattacagataatacctgaaatacctgccaccattccaatgatagaatcggggtagtaaatatatacgccaatttgagctgcaataaataagaaaagccaagctacctcaaagggtttccagccactgaaaaattcttcttttaattggtttataagtattggataattcataataactcctagaatatagtctgatttcttgtattctatctaaattttgtaagaaatgcataacataaattatatttctgagaactagctcacaaaatttactattcaacctaatctctctaaattattagaatgtatattattcactaaattgcatttgatatagctgtttataagcaccacctttttccagcaagactttgtgtgatccgcgttcaataatctctccctgatccaccactaaaatctcatcggcgttttcaatggtagacaagcggtgagcaatcactaaaacagtgcgatctttttgtagttcatcaagggctgcttgaattgcacgttctgattcggtatctaacgctgaagtagcttcatctaagactaaaacaggcgaatttcttaataaggcacgggcaatcgccaaacgctgacgctgtccaccagatagacttaccccgttttcaccaattactgtatccaagccttgtgacattttttcgataaattccatcgcataagcggctttagctgcagcttcgatctgctcacgactgtatttgtctttagctgcataggcaatgttattcgcaatggtgtcgttaaatagatgaacctgttgagaaacaattgcacactgttcacgcaaattgtttaaagtatactcttgaattttatgatcatcaagataaatattgcccgaatcaatttcataaaaacgggtaatcaaattcgcaatggtcgatttccctgagcctgaacgcccaactaacgctaaggttttccctgcaggtaaattaaacgagatattttttaaagcgggttgttctttaccaaaataagtaaaggtaacgttttcaaaacgaatgtcgcctttggctcgttcaatttgataagtgccttcatttttttctgttggtaaatcaaataaggtaaagagcgtttggcttgccgccattcctcgttggaactgggcattaacgttggttaaagtttttaatggacgtagaattcccatcaacgcccctataaccgcagcaaattcccctgccgttaaatcatcaccaataatttcaggcgaacctgcgacaaaaagcaccaccgctaaggctagagaagcgatcacttgaataatcggatcggcaatcgtacttgctgccatcattttcattcctttgcgacgcatatcgttactggtatggttgaagcgttcttcttcgactttctgtccgccaaacgataacaccactttatgtccacgcaacatctgttcggcactttcggtcatgcttcccatagattcttgcatattacggctgagtttacgaaagcgttttgacacaactcggattaataccgcaatcacaggaccaatgatgaaaagaacaagggataaacgccagctataataaaacattgttgtgacgagaaagacaatgtagatcccttctcggaccatgctttgcaacgcatttgccgaagaacttgctacttgctcagaatcataggtaatacgggaaagtaatcttcctgaagagttttggtcaaaaaatgttacaggcataaacattaaatgcttaaatactttttgacgcattgtcatcacaactttaccagacacccacgccaaacagtaggcagaaataaagctggtgataccacgagcaaaaattaggcctacgacaataaatgccatcacttttaaaaagttacgatcagagtcaacgccaaagccatcatcaatcaaaggtttaagcattgtgatcaagtatgcatcggcagcagcgttaaatatcattgccaccattgccacaataatccctattttaaaaagggaaatcataggccataggcgtttaaatgtctgccaagtagagtggtcttgagttatatcatcaagagaaaaaggatttttatttgccattttttatactttctgatcaatcatagtttcccattctaaaactaaatgttcattctgccaaatattcatttcaaagaaaaaatcagatagaattattaaagagacatatttctatctatgcttacaaaagcacaatcaaatctagtttttgaaaggattatatttccttactattttatgatggcttaatagccctcttcacttctaaggattttttatgctacatctactcaaaggggcttatcgtctatttcgttgtattcgagaatttgtgataagtctggtatttattttatttgtgatgttagggtttgcttttatggcgttatggtcaagtgatgctgctaacagcaaaacacctgtcgaatttagtaaaggggctttattactcaatttagatggttatttagcggataatcacgatgaatttagtgattttaatcgctttttacgttctgaattaggtggtacaaatgagccgattaaaatatcaacttttgatgtagtgcgtgcaataaagaaagcacagtatgatgaaaaaattacaggattagtgcttgatttaagttattttgaagggggcgatattccttctttaacctttgtaggcaaagagattgagcgttttaaacaatcaaataaacctgtgattgcaattggtgaaggatatagccaacaacaatattaccttgcgagttatgcggataaaatttatctaaacaaagcaggatttgttgatttacacggtttaaattattccactctctatttcaagtcgttgctagacaagattgaagtcgttccgcatattttccgtgttggaacctataagtctgccgttgaaccgtttttgcgtgatgatatgtcggcagaagctcgtcaaaatgctcaattatggctatctcaattatgggcaaatttcagcagtgcgattgctaaaaatcgccagattgatgcaaacacaatagtgccagaagcaaaccgtttaatcgctcaatataaagcggtgaaaggtgatgatgctcaatacgccttaatgcaaaaatgggtgacggacgtggcaacacatcgtcaaattcgtctcgacttgattgagcaatttggtgaagatcaagacggaaactataaccatatcgacttttttgactattctttgtcgttatctgaccgctttaatgtggtaggcaaggataaaatagctattgtgaatgttgaaggggcgattgtgttaggggaaagcgatgatgaagttgctggcagtgatacgattgtaaaattgctgagaaaagctcgtgaagatgatgacgtgcgaggcgtagtattgcggattaatagcccaggtgggagtgcaatggcatcggaattaattcgccaagaggttgaggatttgcaacaagcgggcaaacctgttgtggcatcgatgggcggaatggctgcctcaggtggttactggattgcggcaacaagtgataaaatcattgcaagcccaactactttgacaggctctatcggtatttttggtttagctgtcagttttgagaaaacggcgaaaaaactaggtgtgaatgaagatggtgttagtacatcgccttttgcacaacaaacagcattaaaatcgctatcaaaagagcaaagtgagttaattcaaattagcattgaaaatggctacgaccgtttccttgaattagtcagcaaggggcgaaaaatgtcgaaaggtgatgtagataaagtggctcaagggcaagtttggcttggggaaagtgcatttgaaaaagggttggttgatgagttgggcgattttgatgatgcctatcacgctttaacaatcttaatcaatgaaaaacgtaaagcgaaaggggaaacagaaatcgaacgctttagcacacagtggctaattgatgaaagtgatgatttgataagccaagtaatgcgtgatttcaaattgcaattacaattaaaagctgttgaatggttgaatttgcctttgcctcaacaaactcagcaacagcttggtatgttggcaaaatttaatgatcctaagcagagttatctctactgtttaaattgtggtagtgtgaagtaagttgagcgagcgtcacaaatggcgttcgtatactctagctaatttagggaaattcgctttgattaatgaattgaggattgcaaaacaagctatacctctttaaacttctcacctaatttttatatagaaaaagcaatgacaatgacggaaacaatgacactttctttaggacaacagctaaaaaatgctcgtgaagcattaaatttgacgattgaggacgtggctcgaaaaacaaatctgaaaaaaagccacctcgaagcgatagaaaatgatatttttattttgccaagcgtgccaccagctttcgtgcgtggttatgtgcgtaattatgtgcgttttctgcgtttgcctgaaacccttgtaaattcagtgaattacggtgaagtgacaattccaaaagaagtccgaaaagctgcaccgattgcggttaaaaaccataagtcgcaaatgcgttgggtaaaagggctgacgtggattgtgttgttaagtgccgttggtatgacgttggcttggtggtggcaagagcatcagaaagatcaggctaaccgtgagcagttgattgtgaataccacagaagcaacggctaaagttgtcgaagagcctcaagtgacaccggttgaaccgcaaccaaccccagcagaagttccgcaagcggtaacattgcctgctaaaaatgcagaacctgcaacaccagcagtggaaagtaatcatcaagagcctgtagctcaagtagcttcagagaaccaaacgactgccactactacagcagtggcagagagcagtacgcctgttgccgtagagcaagctgagctagttcaatctgtgcaaactgagcctgtgcttacacaaacagaagcaaataatcaagcggaagaacctacacaaacggcagtagaggaagaactgcggattgagattacgggggctgaaagttggattactgtgcgtactgcacaaaacaaacgcttagcagaaagactttataaggcaggtgaagtattaagttttaacgataacgaacaatatcgtttaactgtgggggcgcctgctaacgtcaaaatttattacaaagggcaagttgttccactgaaagtagatggacgagttgcacgtttcaaattacctttagcggaataatatgttaaaagaaccacctattaagcgtcgtcaatcgaccaaaatttatgtcggtaatgtgcctgtggggggcgatgcaccgattgctgttcaatcaatgacgaatacacgaaccacagatgtggaagcgactgtagcacaaatcaaagctcttgagcgtgtcggggcggatattgtgcgagtgtctgtgccaacaatggacgcagcagaagcctttaaattgataaaacagcaggtaaaagtaccgcttgtcgcagatattcactttgactaccgtattgcgttgaaagtggcggaatatggtgtggattgcttgcgtatcaatccaggtaatatcggcaaggaagagcgtattcgtgcggtggtggactgtgcgagagataaaaatattcctattcgtatcggggtaaatgcaggctctcttgaaaaagatattcaagagaaattcggtgagccaacgccagaagccctgttagagtcagcacttcgccacgttgagatcttagatcgtcttaacttcgatcaatttaaagtgagtgtgaaagcgtccgatgtctttttagccgtcgaatcttaccgcttgttagctaaagcgatcaaacaaccgatccatttaggcattacggaagcaggcggtgcaagagcaggggctgtgaaatcagcaatcggtttaggtttattactttcagaggggatcggtgatacgcttcgtgtttcattagccgcagatcctgttgaagagatcaaagtgggctttgatattctaaaatcattgcgtatccgttctcgtgggatcaactttatcgcttgcccaacttgctctcgtcaagaatttgatgtgatcggcacggtcaatgcccttgaacaacgtttggaagatattattacaccgatggacgtatccattatcggctgtgtggtgaatggtccgggtgaagcgttagtgtctgatcttggcgtgaccggctcaaataaaatgagcggtttttatcttgatggcgttcgtcaaaaagagcgttttgacaatgataaattgatcgaccaactcgaagcgaaaattcgagcaagagtggcagaacagcataatcgtattgatattgttcaagtgtaagggatatatgagtaagaaattccgagttatttcgttattctctggagctggagggttggatttaggatttaaaggtgggtttgactttttaaataaaagatacgatgaaaatcccttcgaagtggtttgggcgaacgatattaatgaaaaagcttgtaagactttaaaacataatttccctgaaactcccgtagtatgtggagatattacactagttgataaaagtacattgcctgaagctgatgttgttctaggtgggtttccttgtcaagattttagcttagctggaaagcgacaaggattagcggttgaacgtggaaatctttatctcagtatggttgatgttgtagataaggtaaagcctaaactatttttagctgaaaatgtgaaaggattgcttacatggcaaaatggtttagctataaatactattgtcgaagattttggaaagattggctataaaattaaataccaactattgaatacagctaattatggtgttcctcaaactcgagaaagggtaataattgtcggtgttcgcaatgatttgacatcagaatttttctttccccgagaaactcattcagatagcgaggatttatttcaatctacagaaaaatgggttgatttaaaaagggcaatcggtgatttagaaaatgatgaaaaacatttttctctaccaaatagtggctattctaaagctaagttatttcaaggaactcaaggaaacaccaaaacaaaagcggatcgcccaggtccaacaatgagggctgagcatcatggaaatattgaatttcactatagcttgccgaggaggctctctgctagagaggcagctcgtattcagtcgttcccagataactttgagtttttaaattcgacgactgatgcttataggcaggtaggcaatgcagtagcccctgtatttgcatggcatcttgctcaatctgtaaaggaaaccctgaaatgatttatactacagcggatataaatgaaaaacagaaatttgaagagttattagataaaactcgtgatctggtactaaaaaatttagatccatcaataaattcagggaacaaatttgaaagtttggtttttaactgtatgcaagtttgtgctgatggtactttatttaaagggaatttatatcgtacagcagacagagatttccctgatattgttataaataattactggggagttgaggttaaatttactaaggatgataaatggaagtccataggcaatagtgtacttgaatcgtctagaattgagtgtgtaaagaaaatttatatgttctttggtaagtgtggaggaatacccgatattaagtacagaacttatgaggattgtttatttggaatttctgttactcattatcctagatatgaaatagatatgaatttaccgaaaggtgaatctatttttgacttaatgaatatatcatatgatgaattaagaaatcaggaacaaccagttaaatctattaagaaatattataaatctaagttaggaaaagataattcactatggtggattgatgaggaaagtacttttagtagaaattttgaaattattgattttacaaacttagaaaaagagcaaaaacgagatcttattgctgagggatttatcctttaccctgaagtttttaattcaaattattcgagactatgtgcattttgggtttcttactattctattatttgtccaaatatgagagatcaatattctgcaggaggaaaaaagagaatagaggatattgatgaagatctaaaatttatttttaaagttttaggtactcatgaattatctaaactacactataattttttgtttaagtatgtggctcgtattaaacatatattgaattgtattgatttatctttagtttctgaatgttgggacactagcttaacaaatagatatgagatgattagaatatggaaagaaaaaatagataaatatactcctcaagaattctcaataaaactatctaatgcatttgaattagtgaatgataaacttatttaggaaagcacaatgaaagtcgccgtttttagtaccaaaaattatgatcgaaaatacctcgaaatagctaatcaacaataccattttgagtttgaattttttgattttatgctcaatgagcgtaccgctaaaatggcagaaggttgcgatgttgtttgtatttttgtaaatgacgatggtagccgagcagtgcttgagaaactggcaaaagtgggcgtgaaaatgatcgctttgcgttgtgccagttttaacaatgtggatattcaagcagcaaaagagcttggaattcaggtagtacgtgtacaagcttattcacctgaagcagttgcggaacacactgttggcttgatgcttactttaaatcgccgtattcatcgagcttatcagcgtacccgtgaagcaaacttctctcttgaagggctaatcggatttaatatgtacaaacgtaccgttggagtgattggcacagggaaaattggtattgcaacaacgcgaattttaaaaggctttggaatgaatattcttgcctttgacccatttaaaaatcctattgtggaagaaattggggcaaaatatgtcacacttgatgaactttatgctaagtccgatgtgataaccctacattgcccagctacgccagagaactatcatctgttgaataaagaggcttttgacaaaatgaaagacggcgtgatgatcatcaataccagccgtggttcattaattgatactcctgaagcgattaaagcattaaaacgtcgtaaaatcggtgcgttaggtatggacgtttatgaaaacgaacgtgatcttttctttgaagataaatcaaatgaagtgattttagatgatgttttccgccgtttgtcttcttgccataacgtgcttttaacagggcatcaagcatttttaacagaagaagcattgatgaatatctcagatgtgacactgtataatatctgctgtttacaaaaagggggacactgcgaaaatcaaattgaatagaaatagaatacaaaataattgagaataaatatttctaacaactgtttgtctattactcctaatcttaatggctgcttaaaaaggataaatttctctagtatcccaatgctttaaaattgggtaaaaaattgttgttatctaaacgctttaccacagtatcaatcgagccatcaatatttaaacaaagctcacgccacccttgaggaatcgcatctaatgtgaaatcattacaatgtggtttgaattgtatacacgttgaaggcgttgataatatacgatacccattccattgagcatcaacctcttgatgaatatgcccatgtacaatagccttcactttcggaaaagcttttaatgtagcaagtagatcatttacattagaaaggctatgctgatcaagccatgctgaatttgttggcagaatattatggtgtaaaacaattaaagaatatcgttcaggatggacttccaactttctttttaaaaaagcaagctcagaagactctaatctacctttagggctatcttgaatatggctatcaagaagaattatctgccaatgatcaccaactaaaatatgcttttcaggtttaatttgagaataaatagacaaagcattacgcatctgtggttgtaaatcatgatttccagctacccagaagagtggtttaaccaacggtttaaccatttttgcaaaacgatgatatgcctctcgattatggtcttgaacaagatcgcctgttgcaagaatcaagtcatactcaaatgattctttcatgatcatattaagcacagcttgaaaactttgagtggtattaacccctaatagttcacaagtatctgatgcaaataaatgtgaatcggtaatttgtaaaatccgaattattggggagcttaagggaaatatataactatcgtccataatactaaaggttcaaagaaaagccataagatggataagcaactactctactgatttcccaaacgttgtcatcaagaaaaatagaaaaatgtgacatctcctacacttttcacaaaaatttacattgcttaataattttttgcaactctaatatattacatatatgtcaataatgattaatcagaactagtgttagttaaaattagttcaaaaaactatcaaaaattaactcataattatccccatccctattataagaaatataacgaggaaattttttcacctgaaaatttcttcactataatctgtttagcacccgttttgaatctgtaagttatttcctcaacatctatttctcctattctaagaatagctctagattcatttacaatcgtatccttatgtggataaagtttttttaccatttgtcgtttgaaaattatacggtaatactccataatagctgagttgaaatgcaatagaaaataaatcaaacgttggtaaagttaagatctcctgtttaagtggttctactactttcccgtattgaattactgttcccttaacctctgccttagcataagttttcccatttcttatatcttggtaattcaacatattaaattgtttaccttgtattttaccacctgtattaaatactatattatataaaggaatgttaattttagatattattgaataatattcatcactctttttaaaatggatatatgtcggcattatataattagacttatacttgatatgaaactcttctgcccttatagattgaacaatacaaataaaagaaataattaatacttctaattttttaatgcattcattaaatttcctctaaactaacgtactcaaaaagcctagcaatcgcattattatcacgaagttgctcagcttcttcaacttttattttagttaaatgagcagaaaaataattgataaaatcatacatataattacgtaaaaaaacacctcgcttaaaagctatttgtgtcatactagattgaaaaagatggcttgcatcaatagcaactaaatctttgtcttccttcgtatatgccatagttgccataattccaatacctaagccagaacgaacataggtcttaataacatcagcatcagtagctgtaaatactattctaggtagaataccatgtttattaaaagccttatccagatctgagcgccccgtaaaaccaaatgtataagtgattaaatcatattgtcccaactcttcaatagttaatttattatttcccttatttagcttggccaaaggatgatctggttttacaatcactgaacgattccacatgtaacaaggtaacagaataacattttcaaaaagatattgagcctctgtaataatagctaaatcaacctctcctgccattaatgcatcatatatttgtgttggagatccttgatgaagatgtaaacttacggaggggtatttattcttaaatttttcaattatctttggtaatacgtaacgagcttgggtatttgtagttgcaattctgagtattcccttatgcggacttgtttgctcttctgcaatagatttaatcccttgagcttgtgccaacatctcccgagcaattgtaataatacgttcccccgccggagtaagcgctttaatatgttttccacatcgttcaaaaatatgtatacctaattcatcttctaacaaacgaacttgcttactaattccaggctgagatgtataaagtacctcagcagcttctgtaatattcatattttgattaacgatttcaacaatatagcgtaactgctgtaatttcacgtatatatcctttatttctaacttagtacaatattaagtaattgctttaaatccgtaatttcataagttggcttaatttctgtatgattaacttccttgcaagggttaaaccagcaagaatcaatacctatttgatttgcacctaaaatatcagaagaaagagtatctcctaccatcaatattctagacttatttatatctcccatttgttgaaaagcaaacttaaaaattctttcatctggctttggcacccctgcaacctccgaactaatcacaatatcaaaatacttttctgtattagtattttccagacgcttcttttgcaatatttctaaaccatttgtaataattcccattctaattattccaaacaatttttctaatacctctatagttccagataatggtttacttattacagccatttttaacattaattcattatttaaagctaattcgtcttttccaattttttttgcaatgttagagaatcgacatatttgaagctgttcaattgtgatttcttgattttgatatgcaagccacaagggcttattcacagcttgaaaagcttcataatcatcttgggaaaactctataccataacaagctaaaactgcttgtaaacctaaatatgaattaaatgaaaataacgtttcatccgcatcaaataaaatccactgatacttcatatttcctcttgagttattatactactcagatatattaatttctttcgtaatccaatcaacaaaatgctgtactttaggattgtctgatatttgagatggataaacaacataaaatgatttttcatcatttaatcctgtagaaaaaggctcaattaaatttccttgttctaattcatgctgagcaatagtcttgttggcaatagcaataccttgctgatacaaagctgcttgtaatgccataaatgtatgactaaaaattggaccaatttcctcaacatcaatttgttcacttaaaccaaaatattcaatcgttcgcttccatttattacggctaaatacatgcaataatgtttttccaatcagatcttttggtgattttaacggattttcctctaagaacttaggagaagctaaaattactaatggagcttctgttaagcgaatagattccacattctcccatttacctgaaccataataaatagcaacatcaatttcttttccaagctgagcctcatcttgatctacacctttaatcctgacctcaatatgggggaaccgctcatgaaacttactcaaccgaggaacaagccaatgcataccaaaagtttgaggcacactaattgtaagaatttgtctattatttttagaacgaattttatccgttgctttagcaatttgctctaatagcggacgaatttcatcaaaatattgcaaaccaagttccgttaattctaacaccctatttttccgatgaaaaagttgaatatttaaaaaatcttcaagtaatttaatctgatggctaactgcggcctgggtaacaaatagttcatctgctgctttcgtaaaattaagatgacgagcagcagattcaaatgccttgagagcattgagtggcggtaactttttattgttcataatttttactagaaaaagtgagtttttttagattactttttttgataaataaaattaaaaaatctcgtttgtataactggtcaaacatctctaaaattcagcaccatacttagatggatagtgatagctgtcttttagctatttttgaattttaagtatgatgttgtgtttgcatattggtctaggaaactagactagagtaacaaaaaagttactcgtttcacttcctgtatattttgaaccttttggtttagctaccgcccatgttgggcggttttttatagcagaatttcctactattctaccagaatatacaaaaattgccacccaaagccgcactttcgataaaaaatcctatttttttcattgaaaacattcatttttctttagaaacgttgtaaatttctcatatctcatataaaaaaataaaggacacaacaatgactaaaaatattgactgggcaaacctcggattttcttatatcaaaacagattatcgttttattgcacattggaaagagggcaaatggaatgagggggaattaactaccgacagcactttacatattcacgaaggttctactgcattgcactatggtcagcaatgttttgagggcttgaaagcctatcgttgcaaagacggttcgattaatcttttccgtccagatcaaaacgccaaacgtatgcaaactacctgtgatcgccttttaatgccacaggtgccagtggaaatgtttatccgtgcttgtaaagaggttgtcaaagcaaaccaagaatggttagcaccttatggaacaggagcaacgctttacttacgtccatttgtgattggtgtgggtgaaaatattggcattcgtgctgcaccagaatatattttctctgtcttttgtgtgcctgttggtgcttacttcaaaggtggcttagctccagcgaatttccttgtgtctgattatgaccgtgctgcaccaaacggtaccggcggtgtaaaagtgggcggaaactatgcagcaagcctgttgcctcacgaattagccgttgagcgtaaattcgcagatgcaatttaccttgatccaaaaacacatactaaaattgaagaagtcggtgcggcaaatttctttggtattacaaaagataacaaatttattacccctgcttcatcgtctattttaccaagtatcacaaaatactcgttacttcatctcgctaaagagcgtttaggtatggaaacgattgaaggcgatgtttatatcgatcaactagatcagtttgcagaggctggtgcttgtggtaccgcagccgtaattacccctatcggtggtattcaaaatggggataacttccacgtattctattctgaaacagaagttggccctatcactaaacgtttatacgctgaattaaccagaattcaatttggcgatgtagaggcacctgaaggctggattgtcaaagtcgagtaattcattttcaagcagtgagagaatagcaaaaatttgctatctactcaccgctttcattaggagaaacaatgatccaacgatttcaagtcggtaaacgcctatctgaaatggcaatttataacggtgtagcctatcttgcaggacaagtccctaaagatgattcgcaagatatgtacggtcaaacaaagcaagtgttagccgaaattgataaatggttagcccaagcaggcacaaataaaagtcgaattttgatggctcaagtttttgtaagcaatatgattgaatttgatgaaatgaaccgagcttgggacgaatgggttgctgaaggtaatgcaccgccaagagctgctgttgaagcaaaattggctaaccccaattggaaagtggaaattgtggtaactgctaccatttaattagtcgtggaagtacaacataataaaaccagtattaaacgaccctatcccaaattctgtgtaaacacccatttcaacttaacggtgatcgtctaggcgatcaccgttaagttgaaatgggtgtttacacagaatttgggatagggtcaaaacaaaaaaccgcaagctatctctaacctgcggttcttctctttaataaaaccccgacgatgctctactctcacatggggaatccccacactaccatcgacgttacagcttttcacttctgagttcggtatggaatcaggtgggacaactgcactattgtcgtcgggaaaatcttttgatgattctctctatcttcttttttctgttctttaagggcaaatgtaatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggacgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcttacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttccggcgaacgagtttttcactcgttttatcgttacttatgtcagcattcgcacttgtgatatctccagcatacttctcaatacaccttcatcgacttacacaacgctcccctacccaacagacgtatcacaaatattcctctgatttctatccgcactttatgccaactcaacgtgttgggtgcttgaccaacatcttattccgtttcacttcattcgatgttgttaatcgtaaggcgtatttgtgatacgcctgatgccgcagcttcggtgctatattttagccccgttacatcttccgcgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccactgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacaaaaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaaccatacaacctcaaacattttcacttgaagttgatattaactactaaacacttgactgcttttgttcagtcaagatttttcttactactcagactttcttgtttcagggcaaatgtgatttgcccctacagaaaatctctcagttttcagcttgtttccaaatttttaaagaacattcgataatcacttatctttcgacaaaaaatcatctttaaatggcgtccccacggggattcgaaccccggttaccgccgtgaaagggcgatgtcctaggcctctagacgatggggacaacatttaaagatgctttccttcatcctgtcaatttgcaaattttatcgcaaatctgaccgcttgtgtctgttttcttgctctattccttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcgccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacactctcatctctgaaagcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaggtggcccgaaagtcccaccctctagtccttagacattacgcggtattagcgacagtttcccatcgttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaacgtttaatcgctcaatattaaacgtggatttatgatttacgtacaaatatgccgtagctttggtaagcgtattaagacttcaaaattaaaaaaatatatttaaacaaagtcaatcaacaagtgcccacacagattgtctgataagttgttaaagagcaaaaaaagaacgacgcactgccaaatttaattacttcacaacagcacgtcgttgtgtggtgcgcattatagagaaattcaaatccaacgcaagtactttttttgcaaaaaatttgaaaaaatgatcgcttgttcaaaataagctcataatgtttatttcaaaaacaataaatgcctataccttactatattcttatcaaacatcatctgaatatatcaatcatagaaatcttattaatccccttgtattagaatatgggcaaaagaaaaccccattacgagtaccttcataatggggttatagagaaagtagagttgctttgccccttgtgccattaagcacgtagtgtagatataagcctactttctcatccactatcaccccgaatggtatctcaggcacgttttccgtagcccgcattcacaaggtttggaggtcaaatggataacccattatattacgttggcattgatattgccaaagctaaatttgatgttgccattaaattacaaaatggcaaacataagcataaagtgtttaaaaataatccagaaggatttcaatcacttatgcaatggctcaatacatttggtgaaacttttcactgcgtgatggaagccaccaatatttatcacgaagctttggcagattttctgttccaacagcaaatcaccgttagcgtgattaaccctaaatgcagtgcaaatttcacgaaaaccgataatttacgctctaaaaccgacaaaatcgacgcaaaaatgcttgctgattatgccgatgaaaagcgtcataaattaccgatttatcagccaatttcacctgctcaacgggaattgttgcgtaaaaatcgccaacttgaccacctgaaaaaacagttggcacaagaaaaaacacggctaacaatgttgcttgacagcgattgcattgcttcaacacagcagatgattgccttcatcaaagcgcaaattaaggctttggaaaaaacaattaaacagtgcattaatgcagataatacattgaaaaacaatgtaaaattactttgcactattcctgctattggctttgcaaccgccgttcaactgattgcccatttaggtgatggaaatcgttttaaaaacgcgaaagcagccgccacttttgcaggtttaaccccgatgattaaaagttcggggaaaagtttaaataccgttattggtatttcaaaaatcgggcaatccgacattcgtaaggcactcttttgccctgcaatgaactttgcctttggcagctacaaaaacagcgtatatctctcgtttgtgctgcgattgcttgaatgcggcaaacctaaaatggtgattatcacggctttaatgcgtaaattagtcactattgcacaggctgttttgcaaaaacagacagcatttaatttagacacatttatgaaataaaatttgttgtgtcttatggtatctacacatcatgctcaatcaaaaaatctattgtctttcattaatttttctaatatgcttacaccacttaccgatttaaaaagaaataactaggaagtgatttgaatgacaaaactttataacagctcatttgagcgtgagaattgtgggtttggcttgatagccaatatagatggggtgcagagccacaaggtggttcgtaatggtattttaggtttatcccgtatgcagcaccgtggggcgattttggcagacggcaaaacgggggacggttgtggtctttctttgcagatgcctgagagctttttttgtgcggttgcggcggaaagcggttttaccttggcaaaaattttcggtgttggacagatttttttgccacgtgatgaagccttagtcaaagagtatattgagattatcaatgaagaattaacccaggaaacgttgggtattcctgcgtggcgtgatgtgccgattaatccgtctgtgttgggggaaattgctctggcggatatgccaacaattaagcaggtgtttgtgaatgcacctagcggttggcgtgtgcaggatttgcaacgccgtttgtttgtggctcgccgccgtattgagaagcgtatcaatcaccctgatttctatatttgtagtttttctaatcaaacgattgtctataaaggcttgtgtatgccgaaagatttgccaaagttctatttggatttggcggatttgcgtatgcagacggcaatttgtttgtttcatcaacgtttttcaaccaatactcaaccgcgttggaagttggctcaacccttccgttatcttgcccataatggtgaaatcaatacgatttcgggcaaccgtgcttgggcaagagctagggcgtataagtatcgtacgccgttaattcctgatttgcagacggcagctccttttgtgaatgaaacagggtcggattctagctcgttggataatatgttggagctgtttgttagcggtggtatggatttattccgtgccatgcgtttgcttgtcccacctgcgtggcaacaaaatcctgatatggacgatgatttgcgtgccttctatgattttaactcaatgcatatggagccttgggacggccctgctgggattgttttaaccgatggtcgttatgccgcttgtaatcttgaccgcaatggtttacgccctgctcgttatgtgattacgcaagaccgtttgattacgattgcgtccgaagtggggatttggaactatgcccctgatgaagtggtagagaaaggacgtgttggaccagggcagttgttggtgattgacaccaaacacggtcgcttggtgcattctgatgaaattgacaatgaagtgcgagccagacacccttaccgtgagtggttaaacaaacacgttcaacgtttaattccctttgagcagttgcctgaaaacgaagtgggtgaagcgacacttgatgagttacaactgaaagtgtatcaaaagcagttcctttatgataaggaagagctggaaaatgttattcgtgtgcttggtgagagcggacaggaagcggtcggttcaatgggtgatgatacgccttttgcggtgttgagcgaacgcccacgtgtgctgtttgactatttccgtcaatacttcgcccaagtaacgaacccaccgattgacccattgcgtgaagcccatgtgatgagccttgccaccagtatcgggcgtgaaatgagcgtgttctttgaagcagaaggcatgtcgcatcgagtgaatttcaaatcaccgattttggtctattccgatatgcaacagattttgcgtttgcctgcggaacactacaaacacacgatactagatgcaacctttaatcctgatgaattgaccttaaaacaggcgattgagcaattatgcgagcaggcaaaacaagcggtgcgtgaaaaaaccgtgttgttgattgtgtccgaccgcaacatcacggctgaacgccaacctattccaagtgccttagcggtgggggcgttgcaaacctgtttggtggaagccaacttgcgttgtgataccaacattttggtggaaacggcagaagcacgcaatccacatcattttgcggtgttaatcggtttaggggcaacagcagtttatccctatcttgcctatgaaaccattgccgatatggtgcaaaaaggggcaatcaacaaaccgcttcgtgtggcaatggcaaacttccgcaacgggatcaacaaaggcttatacaagattatgtcgaaaatgggcatttcttgtgtgtcgtcctaccgttgtgccagattgtttgaagtggttggtttaaatagtgaagtcatcaacctttgcttccctggtatcaccagccgtatcgaaggggctagttttgcagatttagagcaacaacagaccgcttgtcgtaaacgtgcatggcgacacagccaagatattgaaatgggcggttatctcaaatacaaaccgcaaggcgaataccacgcttacaaccctgatgtggtgaacaccttgcagacggcagtcaatacaggcgattatgaaaaatacaaagccttccgtgatgtggtaaacaaccgtccgattaccacgatccgtgatatgttgcgtttaaaaaccgaagcaggcaaagcgattgagcttcaccgtgttgaacccgcggaaaacttatacaaacgctttgacagtgcggcaatgtctatcggtgcattaagccccgaagctcacgaagccttagcagtggcaatgaaccgcttgggtggctattccaactcaggtgaaggcggtgaagatccgaaacgttatggcacagaaaaagtatcaaaaatcaaacaagtggcatcgggtcgctttggcgttacccctgcttacttaatgagtgccgaagtgatccaaatcaaagtggcacaaggggcaaaaccaggtgaaggaggtcagttgccaggggataaagttaccccatatatcgctcaacttcgctatgcggtaccgggttcaaccttgatttcaccgccgccacaccacgatatttactcgattgaagacttggcacagttgattttcgacttaaaacaaatcaacccgaaagccttaatctcagtcaaactcgtttccttgccgggtgttggcaccattgccacaggcgtggcaaaagcctatgcggatttaatcaccattgcaggctatgatggtggcacaggtgcaagcccattaaccagcgtgaaatactgcggttcaccatgggagctgggtttggcagaagcccaacaggctttggtggaaaacaatttgcgtcataaggttcgtttacaagtcgatggtggtttgaaaacaggtttagacattgtaaaagcagcgattttaggggcagaaagtttcggttttggtactgcacctatggttgcacttggctgtcgctacctgcgtatttgccacctaaacaactgtgcaacaggcgtagcaacacaagacgatactttgcgtaatcagcattaccacggcttacctgaaaaagcgatgaactactttaaattcatcgcccaagatgtgcgtgaaattttggcagaactcggcgtagagaaattaaccgacttaatcggttgcaccgatttattagaaatcatcaatggcaaaaccgctaaacaacaaggtctagacttggctaaattgctctattcgccaaaagtgccagacggcagtagccgtttctgcacccaagccaaccctgcttttgaccaaggtttattgaataaagcgattgtggcacaagcccaaaatgcgtttgaaagcggtttatcagcggatttggatttcgacatcagcaatttagaccgctctgtgggagcaaccctttcaggcttggtggctcaacgctatggcaatcgtggcaatccattgcaaaccttcaacatcaacttaaacggcacagcaggacaaagttttggtgtgtggttagcgggcggtgtgaacctgaacttaacgggtgatgccaacgattatgtgggcaaaggcatggctggcggtcgcattgtgattaaaccgcacaatggcgttgcctttaaaaccgaagaagccgctattgcaggcaacacttgcctttacggtgcaacagggggagaactctttgcatcaggtcgtgcaggtgaacgctttgcggtgcgtaactcaggtgcattagccgtagttgaaggcattggcgacaacggttgtgaatacatgacaggcggtgtcgttaccattctcggcaaaacagggattaactttggtgcaggcatgacaggcggttttgcctatgtgttcgatgcagacggcaaatttgccaaccgcattaaccctgaactggttgaaggactaagcatttgcgatttaccaactcaccaagagcatttgcgtggcttaatctctcgccacgttgaacttactcgcagtgcgattggcgaacgtatccttgctaactgggacgattatgtcgcacgctttgtcttggtgaaacctaaagcgaatgacattaatgccctactaggacacaaacgccgtaccctagatgagttgggtgtgattgtgcagtagaaagtgaaaagatgaaaatgccaatttccctctgaacaagctcccctctttagcaaagaggggcagggggagatttgttaaaaagggataacgaagacaaaatgcgaattaaagaatgatgagaaccatacaaatctctcacttcgacatttcgtctgcccaatctcccctaacccctctttgctagagaggaggattattagaaggaacacaaaaatgagccgtgataatgtttaccaatttatagatttaccccgtgttgatccgtcaaaaattccattaaacagtcgtaaaagcgagtttatcgaaatttaccaaatgtttagccaagcacaagcggagtcgcaagccgaccgctgtttagaatgtggcaacccctattgccaacacaaatgcccattacacaacaacattcccaactggctacgtttggcacaagaaggacggatcattgatgccgcagaactggcacacagcaccaacagcttacccgaagtttgcggacgcgtttgcccacaagaccgcttgtgtgaaggctcttgcaccttaaatgccgaatttggtgcggtcaccatcggtaatgtcgaaaaatacatcaccgaaaaagcctttgaaatgggctggaaaccaacagtgaaaaacgttcccaaagccaacaaaaaagtggcgattgtcggtgcaggtccagcaggattaggttgtgcagacgtgttaatccgcaacggtgttgatgtggtggtgtatgaacgccaacaagaaatcggtggcttgcttacctttggtattccatcattcaagttagaaaaaaatgtgatgagccgtcgccgtgagatatttagcgagatgggcattgaatttaaactgggcatagaaatcggcaaagacatcagtcttgatgatttggttgctcagtatgatgcggttttcttaggcgttggcacctatcaaggtatgaaagccaacattccaaacgaacaggcacaaggcgtttattccgccctgccatttctcatcggcaacacacaacatttgctcggtttggcggcccctgattacgtttcaatgacaggtaaaaaagtggtggtcttaggtggtggcgataccgcaatggactgcgtaagaacatcagtgcgtcaaggtgcagcagaagtcacctgtgtttatcgccgtgacgcagccaatatgccaggtagccgtaaagaatacagcaatgccaaagaagaaggtgtagcattccaattcaacgctcaacccgtagaaattgaagccgaaccattagccgttgaaaccgaccaatcaggcaaagtaacagggattaaaatcatcaaaacccaactgggcgagcccgatgccaacggtcgtcgtcaagccgaaatcatcgaaggcagtgaagaaatcatcgcttgtgatgccgttatcatcgccttcggcttcgccccacacgaaatgccttggcttgcctcaatcggcgtaaccacagacaatcgtggcagaattgcaacgactggcgaactcaaacaacaaactgccaatccaaaagtctttgctggcggcgacatcactcgtggctcagaccttgtggttaccgccatcgccgaaggacgtgatgcggcggagagtatgatggagtatttagatgtatagcaagcggtgagattgtattaaatatttacaagacacattgtattatatagtctgataaagataattgctctcccgaaatatttctaaaaaatatattaatacatagagagagcatttttctttacaattgattcttattaaatgaatctaaacgaataaataattcattttccaaatttaaggtaattaaaacctgttttaatcgagctaacttatcattattactataattagtttccatttggtagttattaggtaaagctactgctactcgtagttcgtctttttttccatctggaacaatacataacttttcagccaattgggtttctaaaaatctagtaggttcctcttggaataattgttcaattacaactctataaagctctgtaacattattaacctctaactgaatatcttggaattgtgctgaaatcaatttcctataggttaaatcatttacatccattaaattaatttctgagtcttgctcttcatattcaggttgtttccaaatattaagaaaacgttccgataataaagtaaatcgaccttcccactcattttttccccatttcgatagagatcttaatgagctatttaaccataatcgactatccttgtataattcacgttttttgataaaacttttattagatagctcagaattatatccagttaaagtcaaattagctaaagtatgtaatttctgttgcataaattcgtattgctgtgaatctaaatcctcataccaatcatcacctgcattttgaggaaaaatatgttcaaggctaatttttttattatttataatggatataaactctttattcttaaagttttctagtctttcaaacaaataggttctatttttagaagcccaattatatatggaacaattttttaatgcctcaatcacctcaacatcattcggaaaacgctgattatttatacgtcttgacaaagatttaacgattgttgatacataattttctgatactgctaactcattttcgttatatagcaccataaaaattttatttaatgcatttgtcgggagtccaacaactagacgtcgaacaataaaagactgtaaccattctaaaatttgaataaattgctccttattaattttatttaaacaactgtaatcgtgataaacatttaataaaaaaggatacgcagttttaacctccaataatttaatatattgcaagtgtaatcgaatatccacatcttcctctctttcaggatttactaatataccataatactttgaaaactgttttaattctaatagatccttctcctgaacccttggatatttacctttaaaagcctcataaattctagttttatttggaatctttttatttattttagtaagataatcacgaataaagtcagaaactttactttcattatttgcatcatctttagcaaatttctcaattatatcccaatattgaaagaatatattttgcttatcactttctaaatccatcaatatataatttctaattaaatctgcctcacttaatgctaagccagttgaatttaaactctcaaaaatacgttgtggattatcctttcctctctctaatgaaacttctacaaacattaatttatctaatccttgtctgactatatctaagttttctagagtaatacaagatttgaaatatttaaaattttccaccaatcgtgaaaaataacccaacccttcactaaaatttcctttataaatatattccatagctgaaacatgattatctgttggcttaagttttaatttatatggtgcagaagaaaacttattaatcagaatagtttcattaatttcgtcggctaagtcatttttttcttgagattttgtgagatgatataacaccaaataaattaacataatggtcgttaatctctgttgcccatcaataataatccactctttaatttgtgaacttgtgtaagcaccattattgtgaatataaacaatacttccaataaaatgattagaaacatcacaatcttgccctatactcaaaatatcatttagaagttgctggcattgttcaactttccaatcataattacgttgatatacagggatagtaaactgtacttttgtgctggttaaaaaatcagtaatttttaattcacttgctttcatattcattctcctgacgatatcaatatatccattattgtgtacaaataaataacgctattaataatttttcggggggagggggtaaatctcaatattctaaaatcctacaccatattttcacaccaaattacctactcgcccagtaaagagtttaaacaaatgtgcttgtattccgaatcgtctgcaatggcaatggataaatctgctacgctgatacctgctgaggcttctccgttcatcagcatataatcatcgtctaaacaatatcccccccccttcgtaaccacaacccgttacgcctattcgttcgctaaaatacgcaccgtgctaacagatgaatttcttgtggaaatgctggtatatcaaccaatttcacattcaatgcaacaaatcaactacctgcactgcctacgatcaacaaataagggtcttgtgctgcttttgccactttgtcagtattacgaacataagttattacaaaccacttagtactcagatgctcaatttttattaatctgatgcaaaaaccgcttcgtccgttcgtgttgaggattgctgaaaagttgctcaggcgagccttgttccacaatttcaccgccgtccatcacgaccacaacatctgccacatctaacgcaaacttaatttcgtgtgtaaccacaaccattgtccagccttcgtttgccagctctttcattgtgtttagcacatcttgcactaattcagggtcgagagcagaagtcggctcatcaaacagcattaattcaggttgaatggctaaagcacgggcgatgccgacacgttgttgctgtccgccagaaagctggaatggatagagatcgactttatctgctaatcccactttggctaataatgctaaggcttcttctctagcttgttcaggttttttaccttgtacaaacacagggccttctatcacattttcgattgcagttttatggggaaagagattgtagttttgaaaaaccatacctgatttacggcgtagagtaaggatctcttttttggctgatttggttgtaaagtcaatgtgcaacggggcatcgttatcaaaggttattgtgccttgctctggcacttctaacgcatttaaacagcgaagaaaggtagttttacctgagccagacgcccctaaaatcacaaccacttgccccttttgaatgtctaaatcaatcccacgcaaaatggtgttattgccaaaagttttatgaatgtttcgtactttaatcattgttatttcgccacatatcgatcaaaacgtttttctaagcgtgcttgaataaagaacagcacccaacagaaacaccagtaaatcaagccagcttcaatgtagactggtaagaagtcataggacatatttgccacttgttgagctacacggaacatctctgtgaccgtcacaacagatgccagagaagtatctttgaatagaccaataaaggtattactcaatggcggtacggcaacacgaaacgcttgtggtgcaataatacggcggaatgtctgcatataggtcataccgatggtataacctgcttcccactgacctttcggcacagaaagaatggctgcacgaatggtttcagaaccgtaagccccgatattgatcgaaaaaccaataattgccgctgggatcggatcaataaaaatgccaatcgcaggtaatccgtagaagacaatacagatttgcaccaacattggcgtaccacgaatgatcgagatatagcctttgacgaaccagagtaacagacgatggaacgcgctattgacgggagtaacacgaactaacgctaccccaacggcaatcgccataccaataataaaggaagcaattgccaaagggatagaaactaaaaaggccgcttgtaccatcggccagaaaccatttatgaccagctcaacacgagcttcggtcataaatggtagagagagtaataaattatttaacactgatgtctttaccaaagaattgctcacctaatctcttaagtgtaccgtcttttttcaattcttcaactgcctgactgatttttgcaagggcttcggtgttgcctttgttcacaataaaaccagcccccactttatccgcagattgccaaactggttttaagcctgaatttggatttttcttcaagtaatctaacaatgcaagcgagtcattgaaggtcacatctgcacgtttttgttgaattaataataacgcctgagccataccatcaaccgcaacaagttcagccccatttttctgtgccagttcgccatagttagagcttaaggtctgagctgcttttaagcctttcacatcttctgctttgcttacacgggtttcatcattacgagctaataacatcgcaccagaccagctatattctgcagacttatcaaaggttgcctgacgttctggggttgttaagcctacttggtttgccacaatatcaaaacgctcaccttttaaacctgctaacattgcgtcccattgagtttctttaaaatcaacttttacgcctaatttttcagctactgcacgagtaacttccacatcgtagcccgttaatttaccgcttgcatcgtggtaagtgaaaggtgcataagttccttccgtacccacagtaatagtgcctttgttgttgatacgatctaataaagactcttttgccaatgctgctgtagaagtgaaaactgccgctaaagataatgcaacgattgataattttttaaacataataagttccttttgataggtaagattgattgcttgcaaatttaagggcaaattagaccgcttgcaaataaccaaatgaaatataaaacaacaaaaagtttggattgataagagattggtggctgttcagcgcctaacagttagactaagcagcccgattaacgtatagaggataaacctcacctatcgctaattcagggttttatttaatgatgaaattattgcttatgatttaacaatgactcccaagtttgaactattctcccgactgacgaaccaagttagctatatcgaatggcaagttattaaacgattcacatatattcaagtgcaattaaaagggctgaactagtctaacggtggggaagagattaatatacccatttatattatctataaggtcaagtagatactagttatttagatagaattgacctttttttcatctgataaaacaagataactagatttttgcccaaataatttctataattcaccgtaattttgagattccccccttagctcagtcggtcagagcaggcgactcataatcgcttggtcactggttcaagtccggtaggggggaccaaataacctttcttagcctatcgcaacctttcgcaaaacccttgatacacaaagccccaaagcctttttatcctttttgcttatcgttttttatcgtcttttttcgtatttaatcgcaaattttaggaacaccgttaggaacacaggttataatattgaaaatccagtgttcctaaaaatcgtgaaagccttgatagataaggcttgcagcgtttttatttttcgtgttcctaaaattattgtgttcctaaggttcctaaattatggcaagaattaccaaacctttaactaatactgaagtagaaaaagcaaaacctaaagataaggattatagtcttatggatgggcaaggtttatttttacgagtaaaagccaatggcaaaaaattttggcttttcaattactataaacctttctctactccacccaagcgaacaaatctaggtattggtgcttatcctgaaatttctttagcccaagcaagactgataagagatgaatggcgtgctttacttgcgaaaaatatcgatcctaaagttcatcgtcaaaatatcgtagatgaagaaatctcaaaaagagaaaacacatttgaagctgttgctaagaaatggcgtgaaaagaaatcgttagaagtacagcctaagacaatggaaaagaattgggcccgattggaaaatcatctttttagtaaaattgggaatgtggccgtttcagagattacccctaaaatggtgataaaagccgtcgagccactaaaagagcgtggtgtaggcgatacgttgcatcgtgttattaggttgctgaatgaagtgctaaattttgctgtaaatatggggttgattgagtttaataaatgcgtgaatgtatctgcaaatttctcaacgcatactgcagaaaataacccgaccatacgccctgaattattacctgaatttttatctgatttagatgatagtaatagctcgatacaagtcaaaattctgattaaatggcaactgctcacaatggtaagaccaagagaagctgtatctgttgaatggcaagaaattgattttgctaaaaagacgtggactattccagccccaaaaaatgaaaggcggcaaacgttcgcatactgttccattatctcgtcaagcgatcacccttctagaaaaaataaaaagtatcacaggctataagcgttttgttttccagagcggaacaaatccgaataaatcaatgagttcacagacagccaatagagcaataaagctacttgttggcggtaaatataaagacagattaacagcccacggattgcgctctattgccagcacatacttaaatgaacagctaattaattatgatgtgattgaggcttgtctatctcacatcatcgcagatcaaacaagaaaagcctacaaccgttcagattattttgagcaacgaatcgaagtgatgcaacagtggggcgattatgtagaacggtgctctataaaatctactctataactttgaacgcctagcctacccgctgggcttttttctttcccattcatcaccatttcataaaaaaataatttttttaaaaatttagtcacttattcacttattcacttattttttcttttaacttattgaaaaataaagaataaatagaagtgactaagatagtgataattaagtgactaagtgactaaatctagtgattaaaaattttctcaaaattaacctttcctagagttttgtaaatttagctatcgtttattttcgtatcctaactataaaaattcccttactttacaacgagttattagcctatatattgtgttatgggcttattgtaagccgtcttaattaagagggtttttatgaaaattcacaatcaaattagaaaagaagtaattgattttctgacagagcatttacaggaaatttattactttcataacagtttaccgaagattatcgacactgataacgaattgcctttagttgcagtgtacttaaatgatgcttcaggtgaacccgttactattgggcattctgaatggactgcagatttaatcattctgacctacttacctttttatcaaggggaagaaaagctagatgaaattaacgaaaaaattaatgatgccattctattcaaagactttaaaaacttttctctaactgctgattttaatcagtcttacgattatgaatacgacactgaaaataatgtgtgggtaagttcagctttaaccttccgtattcagtataaatttcaacaactaaacaaatccaatttaggagatgaataattatgttcaaaaaattattagagttacgccagcaaaaagcacagattgaaacagaaatgcgttcaatacatctatgcatatccaaaaaccacgcaagaaattttagattttggcagcgtagatattcttagctggctcactgatgaaatcacagaatcttttgcagaaatcgaagaaacggatttaaccaacggtacaggtacaaaacaggcaaaaggcttcttagcttaccctcgcaccacagcaaacgataagacccgcccattcggtacactgcaaaaaatggaagtagttccatctaaattaaatgcagatgcattaatcgatctgctttattcattgcatagcaaataccgtaaaaatgcggtatgggtgatgaactcacaaacagcaggcactttacagaagctcaaaaatggcaatggtgattatatttggcgtgatggtttacaagtgggtgctccatctactcttcttggtttacctgtttactatgtggaaacaatgccaaatgctcaaggcacaaatccattcttagcggtgggtgattttaaacgtggctatacgattgtcgatcacgaaacaggcacgcgcacaaaacctgatgcaatcacagaaccaggattctataaaatccacacggataaatatcttggcggtggcgtggtagattcaaatgctatcaaagtgttagaagcgaaagtatcttaatccattacaggggcgtaacagcccctttttgtctttatggtggcaataatgaaagatttagaaattagatccacaaccctttcaaccgatggcgaaaataaaaaattagtgggttatgtggtgcagtggaacaaagaaagcgaagtgttatggggtgagtatgtagaacgattcgccccgaatgctttttcagacagcctaaaaagtggtaaggacgtgcgggcgttgtttgagcacgaccacacaaaactattgggtagaacttcaagcgtaacattaacacttgaagaagatgcaacggggttacgttttgagctgattccacccgacacacaattagggcgtgatttattgattagcgtagaacgtggcgatattagcgggatgtcgtttggattcagaacagtaaaaaatgaatgggatttttccgtagagccgaatttgcgaaccgtacaacaagcggagctggtggaggtgactgtaacaagcattcccgcttaccctgattcaagtcttgagattttaaaacgttctcaagcggtagcaaaaggcgaaaaatttacacattggcaagatgaaaaccgtcgtaaatggttagcggtactgggggcgtagatgttcggatttttcaagaagaagcaagagcctgaaacccgcagcttatctattgatgaagtgatggcaacaatgggagcaactaacacaggtgcgggggaatttgttagcccacatactgcagaagcgttacccgctgtattaaatgcggtaaatgtgatcgctcaagcggtggcatctatgccttgctatttgtttgaagtcacaacagacggacgaaaacgcatagaaaatcatagtgttgagtatctgcttaatgaaatgccaaaccgtaaccaaaccccataccagcttaaagaagtgatgatgcgtcacttactgctaaatggtaatgcatatgcggtgattggttggaatagcaaaggacagcctgaaacattaacgccattcccaccgtatgcggtcaatgttcagcgaaccctaaaaggtgattatctttaccaaatcaccgacttaaacggcaaagtaaacaactactttcaagatgaaattttacatttgcgacacgcttcaaatgatggctttatggggcgttcacctattaccgtttgtcgtgaagccgtcggtttagggttagcccaacagcgacacggttcggcggtaatgaaaaacggcttaatggcgggcggtattgtcacaacatccgaatggttagatcaaaccaaagggcaaaaagccttagaagccttaaaacgctatcaaggtgcgaagaatgcgggcaagactccactgcttgaaggtggaatggattacaaacagctagggatgagtaatcaagatgcggaatggttgggcagtagaaaattcactattgaagatattgcccgcattttcaacattagcccgattttcttacaggactattcgcattcgagttatgcgaatttcagcgaagccagccgagcatttttggggcaaaccttaagaccgcatttagtcaattttgagcaacagttaaaagatgccttgatgattgatctcactagtaaaagccgtaaacgctatgtaatcgaatttgacacaagcgacctattacgaaccaatcagcaagaacgctttgcgagttatgacaccgcaatcaaatgcggcattcttagcccaaatgaagcacgtaagcgtgagggattacttccttatgttggtggcgatgaatttagtcaagcgtggaagcaaacagtagaagttaaaaaaggcggtgaagatggcaagaatggttaaggctggcacttatgacaaggtgatcacactgcagcaaatcgccaaaccgaaacccaatgaacaagggaaaattattcgtaatggctctgttttaaaaaacgaatgggaagatattaaaaccctacgggcaagtatcgagcctattcaagggcgagaatatttcagtggcgtttttcagataagtgataccgttgtacggataagaatgcgttatcagcctgatcttgaagtaaccagaaaaatgcgggttaagtacggaaaccgaatttttaaaattgaaaatgttatcgacagcaaagagcaacataaagaactgcaattaatgtgtaaggaaggagaagctcacaatggttaaacctgaaatagatttagatgaaatcaaagcccatttacgcatagagcacgatcttgatgatgaactactaaccttatatgcggacacggccctagaagtagcacagaaccatatcggcaaaacgtggggagaatcaaccacagccgaagcggtacagtttacgaatggcattaaggttggttgtttaatgtttatcgggcatctatatgcgaaccgtgaaaccgtgagcgatgttcaactgcatgaagttccattcgctattaaggcattatggaatccatacagagaagtagcaatttattaacggtggtacacaatgccaatgcaacctttaaagcgttgctctttccctggttgtcgtaatcgtgtgaaggctggcagatgtgaagaacatcaacagaagaagcaagataatagattgcccgcaagcaaacgtggttacgatcatagatggaccaagtacagagccgaatacttaaagcataaccctttatgcgtgatgtgcttagcgaaaggaagctacacaccagcgacagtaatcgaccatatcaagcccgtacagaatgggcaagctgatccgctcttttgggtaatgagcaaccaccaagcattatgtcgtgattgccatagctacaagacaagagtgatagataagcgtggatatggagcgaagaagtaaaaggtatagggcaaagcactacacctacaacggattacagcgtaatgatgtgttgtaagggattcgtgttatacgaatacctacttagttgtggtcatatgaccataactgaaacatctcctcaattttgagctttgctttaaaatcaatgagttataaagaaattgaacaggtgggggggagtttttgaaagaaaagcccaaccgctaagaaccgccccccactcaatttttacgcacgacaattttttagaaaatataggcattcccgaaataatagggatttaattcccgaaaaagtagggaactaaaggagaatagcaaatgacaacaaaaaccccaaaagccccaagttatttagatgagattgctagagagcaatggaaattaaaaattaaagtgttggcggaacgtggtgatattactagcgaagattacaccaacctagaactttattgcgtgaattacagcctttatcgcaaagccgttcaagatattgcagaacgtggcttcagcattacaaacagccaaggcacagaagcacgcaaccccgcacttactgcaaaaagcgaagcggaaaaaatcatcattaaaatgtcttctttgcttggttttgatcctgtaagcagacgaaaaaacccaatagacaccgaagaaacagacgaaatcaacgaaattttaacgatgtaaatagcttatgagtgaatggaataactacgctttagcggttaaaaatggcgaaatcgtggcgtgtaagcgtatcaaacaagccgtagatcgctattttgctgatttagcaaaccctatctactgttttgatagcgaaacagtagagaaatttatcaagttttctagattatgcccacacgttaaaggacacctatacggacaaccgatagagctttcagactggcaaatctttctctttgcgaatctactcggctttaaatatcgtgatagcggattaagaaaatatcgctctgcttacgtgcaggtagcccgaaaaaatgcgaaatctaccataggggcaatactggcgaattggttcttagtgatggaaaaaggacaataagatatttacaccgccgccgtcagccgagaccaagccagaattgtgtttgatgatgcaaagaaaatggcaatgttatccaaaccactaagcaagcgtttaaccattcaacagcacaaaatgctatttctgcaaaaaaacagcttaatgcgaccgcttgcgagtaaatcatcaactattgaaggcacaaacccaagtcttgcgattgtcgatgaatatcacctacaccccgataacagcgtgtacagtgcattagagttaggacaaggggcaagacccgaagggcttttatttgcgattaccacagcgggcagtaacaccatttcagcgtgtaaacagcattatgattactgttgccaaatcttagacggcacggaaaaaaacgaaagtatcttcattctgatttacgagctggacgatgaaagcgaagtggacgacccgacacaatggatcaaggcaaaccccaacataggcaaatcaatcccctataaagattttgagaacaccatcacaaaagcccgtggtattccgtccgaatgggtggaaatgcttactaaacgctttaatgtgtggtgcaacggctctacaccgtggctaggcgaaggaaactggaaagcgtgcgggcgaaactatgaagaagaacgcttacacggtaaggcgtgctatatggggcttgatctatcttctacgaatgatattaccagcctttgttacattttcccgacggaaaacaacaaagtaaggctacttacacggcactacattcccgaatatcaactgcagaacgtggctaataaaaatcgggctatctatcaacaatggcagcgtttaggctggttacgagtgacaaaaggtgactgtatcgactatgacaaaattcgagatgatatttttaacgatgcaggaaagtttgaaatcaaaatgatagggtttgatgtatggaacgccacacatctacgcacacagctacaaggctacggcttagaggttgaaccattcccacagacctaccaacgttacagccccgtggcgaagtcggcggaagtgctgatcaatagacaaatgatagaacacaatggcgatcctgtgcttgcgtgggcgttgtcaaatgtggtaggggaccattcaaggtttgataaattttcttacattcccctttcaatatccctccttacgcacatagacattttaaaaaacgaaggaagatgaaaataacatttttaatattttttaaaagttataagcatacagggctaatagtctccactaaaaaatattaaactgtccttccttaatcagatagctattcttaatattatacagaagtatgaggtgattatataagcatcccagaaagcctagccactacacaaaacataagacaaatgagtttaagaatattcaaaccccattttacgcggcatcagtgaaaataaaagacatagtagacaaaataaaaaatgtggcattacggattaaataatgccacataaactcgacgatattgaggaatttcttcttattatttgataacgattataatactctaaatacgaaataaaggcgaagaaataattcaacttttttcaaaaattggagcaagatcacaaaatttttcacttcctcctaaaattctctacacatacccataacccatcaaccgctgataacggcgatcaagcaatgcttctgcatttaacggatccaagtctgctaaatcctcaagtaaacgttgtttcaaatttgctgccatctcatcaaagttacgatgagctccgcctaatggctctggtacgatattatcaattaactcaagttcttttaaacgtggtgcggttaaacccatcacttccgcagcggttgaggctttttcagcactcttccataagatagaggcacaaccttcaggggaaatcactgaataagtgctgtattgcaacatattcactttatcgcccacgccgatcgctaaggcaccgcctgaaccgccttcgccgataaccgtacagataacaggtacttttaaggtggacatttcacgcaagttgcgtgcaatcgcttctgactgcccacgctcttccgcaccaatgcctggatatgcccctggcgtatcaatgaaggtgatgatcggcatattgaaacgttctgccatctgcattaaacgaagggctttacggtagccttctggtgctggcataccgaaattgcgtttcactttttctttcacggtacgccctttttgatgcccaattaccatcactggacgaccatctaagcgagcaataccgccaacaatcgctttatcatctgcaaaagcacggtcgccagcaagttcatcaaattcggtaaaaatacgctcaatataatctaaggtataagggcgacttgggtggcgagccatacgagaaatttgccacgcatctaaatctgagaacgttttcttggtgagttcttcactttttttctgtaaacgtgcaatttcatcatcaagattgattttgttgtcattacctactgcggaacgcaacgcttcaatttttgcttcaagctctgcaatcggtaattcaaaatctaagtattctgttgtcataatttttcctatctgttttggcagaaataaaaaccgctgtattttatcagtgaatgtgacataagcggtaagatttccacatttttttgcaagttttctcgctgatccgaccgcttaatgctattccgcaacaacaaattgccccatacagccacgatctcgtaacattaaatcggataccccgaaggtgaatggctgttgctcagaggctgtatgctcaaacttaactaacaatgtagtttcttgggttggttctaaccatacacaatctcgccaagccaactgtttatgaggcacagcctgacgatttctcgtttccaccataaatttggcaccctgtaaggtaaaaccaaccgcttccgttgtggtcaaataccaacgttccactgttcctttttttaccgtaaaatcgatccgcttaggatcaaatcgttgctgattgattaaacggtcttgtgggcggagattgattttacgttcttgggtaatttttaagttaaactcttccacattaaatgggggaagttttggtgtcacatttaacgctgaaggcaacccctctgggcgaaactctaacaccacattatcatttaactcattgttatctttgaataatttcccaatttcatcaaaaaaatctcgcttcttgccagtgattaatgaaaccttatctccctcatttaagtccactaaaacttcaattcgttccgatggagcaagggaaatatgttccatttcaaccatatccgctaaaaaaccaatccccgttgcaattaaatagagcggtttgccattgtctaaacgtaaatcataatgacgagagagggaagcattcgcaatccgcaaacgaacccagccacgaggtacatcaaaataagggctttcttgcccattaacaaaaaggcgtttgccaaaaaattgattagtttgagtgtcaattacttgaacgccatcactgttaatcaactgatcttgcaaaatcagcggaatatcattaaccccatatttattaggcagtgacgcttttctactttcattatcttcaatgatccacaaacctgccaaaccacgataaacttggaaagcggaatttaacattgtgtctgcgtgataccaagccgtacaagcggattgattaaccgataaaatcggcgaccaactgctgtttttgtctatagcacggtgaatagaaccgaccatttccgttggagcttgtagcccttggatattgatcgataatgcttgtggcaggttgttagtataggtcagcttgacaaaatcacctgacttcactcgtacagtgggggcaagataacgcccatttacaccccaaacatcaaccagtttccctttattaaattgcgtttgagcaggacgaaaatccaatcgaacaggacgaccacgccccacttcaatcatcggcggaatggttaaactaggacgatttttcgcccataacgacgtaggggcaaaagtagctaccccagctaatgtagagcgttgtaaaaattgacggcgagaaagtttcatattatttacgttctaattgtgcgacttcttgatctaattgttctattttagcctgcataatttggtgacatttttcaatcagctctttgagattttcacggtcataacccgacgtatcaatcggttctaattgctcacaaatcaccacgccattatccttacgatttaagtcaattttattatgagtcgttgaacagacaatcggcacaataggcacaccagctgcaatcgccgtatgaaatgctcccgttttaaaaggaagcaacccacgtccacgactacgtgttccttctgggaacatccataccgagatttgtttgtcacgaataatctcgccaaccttattcatcgtattaatagcactactacgtttttcacggtgaataaaaatattccctgttgcccaataaactaagccaaaaaaaggaatacaaatcaagctacgtttacccatgctcacggttcttggtggtaccattgctgcaattgtcaccatatcatagttattttggtggtttccaatataaatagctggttgattaaatgtcgctttattgcgtgtaattaatttaatgccaaccaacttatgcagtgaaccaaacatatttgccacaacgctaacactatctggatggcgtaaccgtactaacgcataaagcgagccaacaatactgattaacatagcaaaggaagctactgcaacaatgcgaaatagttttaacatagtaaaaaacctttaagaagaaatattatagaaagtatagccgagatgtcctcatttgccaaaaagataagcatcaactattgctaaaattcattttcattttgttaagaaatcgttatattgagcaagttttttcaacctatttaggagttattatgagtcaagttacattagctggaaatgctatcgaagttacaggtcaattcccacaagcgggtagttcagtggcggattttacattagtgagcaatggcttagaaaacgtatcactttccgacttcgcagaaaaacgcaaagttcttaacatcttcccaagtattgatacaggtatttgtgcaacttccgtgcgtgttttcaataaagaagcagccgaactcgcaaacacagtggtactttgtatttctgccgatcttcctttcgcccaagcacgtttctgtggtgctgagggaattgcgaacacccaaacactttcaacattccgcaacaaagccttccatcaagcggtaggcgtagatattgcaacaggcccattagcaggtttaactgctcgtgcagtgattgtattagatgaaaacaataaagtgctacacagtgaattagtccctgaaatcaaacaagagcctgactatgcagcggcgttggcagtgttgaaataagacgattcattgaatgataaaggacgccagcatgacgtcctttatcacttaaacaatatctaataattctacttcaaaaattaacgtgctaaatggcggaattgacgcacctgcaccacgctcaccgtaagcaaggttatgtggaatggttaaacgccattttgaacccacaggcatcatctgtaatgcttcaacccaacctgcaatcacgccggtgactgggaactctgctggtgtaccacgtttcactgagctgtcgaataccgtaccgtcgattaatgaacccgtatagtgaacacgtactttatctgttttcataggcactttacctgtaccttccactaccacttcatactgcaaaccgctttccgtttctttcacagatgggtgttttttattctcttctaagaacgctttaccctctgccgctaacgcttcaaaagcttttgcttgttctgcttcggcacgttgagataactcttgtaacgctttggttacttcattcaaatctaatgcaggtgggttttgatttaacacatcaaaaatcccttttaccaccgcttctggttcaacatctaaaccactgcctaataattgctgaccgatttgtaaaccgataccataaccaccttttgcttcaacgctttctaatttcacttgttctaaatttaaagacataatttttccttatgtgtagaggggatcccccgttaatgtgtttatataaattcgggcgaggataaacctcgcccctacattcattaaaataatgactgctgtaatatagagccagattggcaaattacaagtacaagcggtcggattttggcaaaagaaaccaccgtcccaaccgtaaacgtccactaatttacccattacccaacctgcacttgcagaaccaagtaagtaactgaataaacctgttaaacctgttgctgtacctgttgcaacacgtggtactaaatctaccgcttgtaagccgatcatcattaccggaccgtaaattaagaaaccaatcgccactaagcagatgttatcaactaacggattgcctgctggttttttccagtaaactacaatagcaattaatacaccaacgaggaatagtaacattggcggcgcacggtgacctttgaaaactttatcacttaagtaaccgcttgcaagcataccgaagatacctgcatattcataaaggaagtatgcccagctttgtttatctacggtaaagtgtttcacttcttttaagtaggttggtgcccagtcaataatcccgtagcgaatgaagtaaacaaatacgttcgcaatcgcccataggaatttattgttgatgatatatttgtagaaaatgtctttagaagaaagggtatgcgcttattccactttttctaatactttctctcctttccattcatcaacaggcggtaagccttgtgattccggcgtatcacgcattaagtaaagcaccacaaaggcaagtacaattgcaatcagtgccagtaaatagaacaaggattgccatacaccgaagatagataaccccaaaatcgctagtggaccaatcaaactgccacctaagttgtgtgacacgttccaccaactccaccaagctccacgttcagaacgagagaaccagttggtcatcgttttagcacctggtggataacccataccttggaaccaaccatttaagaccgcaagtaagatcattaatggaattgaagaaagtacgcccagtactaaaccaaaaatcaagctgatgattgctgatccgaataaaccaatggtgatgaaatattttggatttgagcgatctgaaacatttcccataatgaatttactaaatccataagcgagagataatgccactgcgaccgtaccaagatccgctttgctaaatccatattcttcgattaaataaggaatggctaaagaaaagttcttacgaatcaaatagtaagctgcatagccaataaacacaccagcaaatacttgccaacgtaatttgcgatattctgcgtctgtacgagaactttcaattctcggtgcaggtgcagatgcttttaaaaaagaaaacatacaaactcctttgtaacttttataatataaaaatttcgcttttaaacattttttgataattaatgttcgttttgaattatcggttaaaaatactttacattacaaatgcgtattgtaagttttatgatatagatctaatttttaaagtgggtttgcctataaaaaaacaacaacttagagtgcaaaaacgtttacgtttttgcaaaaaatctcgcaaatctcaccgcttgtgattgactaacgaaggtgaacagatacaatcacatcatttgaattgtagggtgggggttgcctcaccacctacgagccatattttatggtgggtcaagacccacccaacacttaaaataacaaggacaacattaatgaacctatacaacatcaaacaccctgaagaacaagtaaactttgcccaaggcgttcgccaagggttaggtaaagatcagggcctctttttccctgaagtgttacctaaatttgaagacattgacgctttattagcattaccgctggttgagcgtagccaaaagattttatcggcattgattggcgatgaattgccacaagaaaccttaaatgcaatggtgaaaaatgcgtttactttccctgcaccactagcaaaagtgaataatgatatttatgcgttagagttattccacggtccaacccttgcttttaaagactttggcggtcgctttatggcacaggcattaagtgcggtgcgtggcgatggcaaaattacgattttaacagcaacatcaggtgacacaggtgcggcagtggctcacgctttctacggtttagaaaatatcaatgtggttattctttatccgaaaggtaaaatcagtccattacaagaaaaattattctgcaccttaggtggcaacattcgtaccgtggcaattgagtcggattttgacgcttgccaagcgttagttaaacaagcctttgacgatgcagaacttcgtcaagctatcggtttaaactctgcgaactctatcaatatcagccgtttgcttgctcaagtgtgctactactttgaagctgtagcccagttgccaaaagagaaacgtagcgatgtggtagtttctgtaccaagcggtaacttcggtaacttaactgcaggcttaattgccaaaactttaggcttaccgattaaacgttttatcgcatcaaccaatgctaacgacactgtgccacgttatcttaaatcaggtaaatgggagccaaatgcaacggttgcgacactgtcaaatgcaatggacgtaagccgtccgaacaactggccacgtgttgaagagctgtttaaacgtaatggttggaatttggcgaatttaggttcagatgccttaaatgatgcagaaaccgaagaagcattaaaagcacaatatgcggaaggttacttatgtgaaccgcacggggcaatcgcttaccaagtattgaaagatcagctacaagctggcgaaacaggtattttcctttgcaccgcacaccctgcgaaattcaaagagagcgtagagcgtattttagacattgaactgcctttacctgaagcgttagataaacataacaaaatggaactgttgtcggacacaatggcggcagattttgcgaagttaagagagtatcttttaaaatagcattccctataagcggtaagatgaaggcaaaatacattatcttaccgcttatttttataccaaaaacaacacaggaattaaattcatcaccatcatcgtcaaaatcgactggatcaagcgggacgatccgaagataaatccacgatttttaccgttatcaaatttcactaataaattcgccattgccgttaatgcatacacttcaagcaaggtaaaaatcaccagatagagatagccagaaaccaacgaagcataatgcaaggtgataaaccaaggcacaaccataccgacggctaaaatcgggctaacgaaaataagttgcttacgggttaaattgatatgcttggagaaatacgattgtagggcaacggtcatcaacccattgataaataacgcaatcgggatctgctctggggcattgagtttattgtcaaacagataaggaaaaatcacaaaaaacgacattgcaacacttaacggtacaaacagcattaagtgaacaaaaataaactctttggtgatgatttcccgaatttgcccccaacgaaatttcactaaattgttcacattttccatttggtagaacggctttgccataaacacaaataacaccgcttccaataaaaaacagcaccagattaacgcattgatctgctcatacttgataaagggaattgcaagcaatggagctgccatcgacgacatactggtgacccgtaagaatttgccttgtaaacgggttttcgccgcatattcatcgccagccaatgcaagtaagcacgcccttgcattagttgcaaacagacaacttcccataccaaagcacattgtcgccattaatagcaccgtgtagctttccgcagacaagaagaaaacataggcgatcacatcgagcatacagccgactaacatcattttcgctaaaccatagcggtcgcctagcacccctgcaaaaattgcaagggcttggctacaaaaaaacagtaccgacaacgaaaatgcgatctgagcgttagataagcctttttgttgcaggtagataaaaaagaccgtttgcattgaaaaataagcaagggtcgaaataaaacgacgagtgagtagtagtttttctaaggacatttgaatatctataaacggctatctgaatatgtagctaatcctatgttatgaatatattttacaatgttgattttttatataaagaactattattcatatcgtgctttaattattctctatggtacaaagatcatcattattggtaagcattttaagattcactcacataatacaaacgctcctattcccttcaatcttttgcaactcgcccccatagcgagtacaattcttccatttgcaatatttcggataaatcaaaccgcttgtatgtcatttgaacttcaatttcgtctgccgaaagcggacagcacacatcaagatcatcaaactttaggtaacttaatcgggcattccgatacccttgcgattgtgcagacaagccagcaatttcaaggcttgacggtggtggtgacacctgatactcgcacagcgttgcggttggaaaaaagtttgccgagctttactaaactgcctgttcagctttttcctgactgggaaactttgccttacgacaatttttcgcctcatcaagacattatttccgcccgtttatctgcgttatttcagttacaacaagggcagaagcagatttttctgttgccaatcaataccttattacaaaaagtctgcccaccgagttatttggcaaacaatgtactgttgattaaaaaaggcgaccgtttttcgattgagaaattgcgtttacagctggaaaatgccggctatcgagcggtggaacaggtgctggaatatggcgaatatgcagtgcgtggggcgttgctcgatctctatccgatgggggcgaattcgccttatcgtttggacttttttgatgatgaaattgacacgatccgtacctttgatgtggataatcaacgtaccattgagcagattgatgcaatcaatttattgccagcccacgagttcccgacagatagcaacgggatcgagtattttcgtggcaaattccgtgaacaatttggtgaaatccgccgtgaacctgagcatatttatcagcaggtgagcaaaggcattttgaatgcagggattgaatactggcaaccgctcttttttgagcaaatggcgagcttgtttgactatctgcctgaacagacattgtttattacctttgccgatattcagcaaaaagccgagcaatttcaacaagataccgcaagacgctatgaaagtcgccgtgtcgatccgatgcgaccgctacttccacctgaacagctttggttcaatatcgatcagattaaccaacagctaaaaggctatccacgtttaactttaaccaacgagaaagttcgcaattcggcggctaagcagaacgccaaccttgagccgttgcctgatattgcggtgcaatccaaccaaaaagaaccttttgcctcttttttacagtttcaacaaacattcaaggggcaaattctcttttcggtggaaacggaaggcagacgggaaaccttgcttgagctacttgcaccgctaaatatcaagccaaagcaagtgaagcaactggctgagattaattcgcaaatttctttgttaatctcaccgcttgatcaagggtttattattgaaacaagcggtcaaaaactggcgataatttgcgaaacggatctgttaggcgagaaagtacagcaaagtcgccgacaagagaaaagccgtaaaaccgttaatcctgacaccttgatccgcaaccttgccgagctgaaaatcgggcaagcggtggtgcatttggaaaatggagtcgggcgttatggcggtttaaccacccttgatgctggcggtattaaggcggaataccttgtgttgcattatgccaacgatgccaaactttatgtgccggtggcttcgctccatttaattagccgttatatcggcggaacggacgaaaatgccccgttacataaactgggatcggaagcgtgggcgaaaactcgtcaaaaagcggcggagaaaattcgtgatgtggcggcggagttgcttgatgtctatgcgaaacgtgaagcacaaaaaggctttgcgttcgagtacgatcgtgatgcgttcgtgcaatttagcaacactttcccgtttgaagaaaccgaagatcagaaaacggcgatcaatgcagtgattagcgatatgtgcttgccgaaagcgatggatcgtctcgtgtgtggcgatgttggctttggtaaaacggaagtggcaatgcgagcgaccttcttggcggtaatgaaccataaacaagtggcgatcctcgccccaacaaccttgttggcacaacaacattttgagaattttaaagatcgttttgccaattatccgatcaacgtggaagtgctttcccgtttcaaaaccgccaaagagcagaaggaaattctggcaaaagtggcggacggcaaagtcgatattttggtcggcacgcataaattattgcaagaagatgtgcagttcaaggatcttggcttgttggtgattgacgaagaacaccgtttcggcgtgcgtcaaaaagagcgaattaagcaactgcgtgccaatattgatattctcacgctcacggcaacgccaattccaagaacgctcaatatggcgttgaacggaatgcgagatctgtcgattatcgctagtccgccggctcgccgtttatcaatcaaaacctttgtgcgacaaagcgatgatacggtgatcaaagaagcgattttgcgtgaaattctgcgtggcggacaagtatattatttgcataacgatgtggcgactattgaaaatactgcacaacagcttgccgaactggtgccggaagctcgcattgtgatcggacacgggcagatgcgagagcgtgagttggaacgggtaatgtctgatttctaccaccaacgttttaatctgttggtttgctcaaccattattgaaacagggattgatgtgccgaccgccaataccattattattgagcgagcggataaattcggcttggcacagctacaccaactgcgtggacgtgtcgggcgttcgcaccaccaagcctatgcttatatgctaacccctccaccaaaaacgctgactaaagatgcacaacagcggttagaagcgatgagtagcattgataaccttggagcaggctttgtgctggcgacccacgatcttgaaattcgtggggcaggggaattactcggtagtgagcagagcggacagattgagagcttaggcttttcactctatatggaactgcttgaaaatgcggtcaaagccttgcaagaagggcgtgaaccgactttagacgaaatcacccaacagcaagtggatattgaattgcgagtgcctgcgttactgcctgatgattatctgcctgatgtgaatatgcgtttgtcgttctacaaacgcattgccagtgcagagagtgatgaagccttaaaagatctgaaaattgagctgattgaccgcttcggtttactgccagaagccacgaaaaatctgttccagattactcagttacgccatttggcaaaagggttgcagttgaaaaaagttgatgcagggatcaacggcggttatctagagtttaaaccaaccgcaacgcctgatccgatgaagtttttaaagctgatccaagcggataaaaatgtctataaatttgacggcccgttgaaattccgctttaccaagccaatggaacgaccagaagatcgcttggcgtttgtggtggagttgattgagaaaatacgttaaaagcaaaatagccacgttatacgtggctattatctggtgacaatcattgaagttgaactaattaatgcagcgaacaccactttttttgatttaggcttaaaggacaaaattaaatatctatagccaccctttgcgtttaaaataaagatatggtgtcgcagcagcacaaatcattaagccaatcgccattggataaccatatttaaatcccagttctggcataaactcaaaattcataccgtaagtagatgcgaccaatgttgcaggaaggaacatcacggacactaccgagaaaaatttcataatacggttctgctcaatattgataaaacccattgctgcttgcattaaaaagtttaccttttggaaaagcgattcgttatgcggttgaagtgattcaatatctcgcataatatcacgagcttgttcaagctgattatttggcaaacgggttttacgcaataagaaactcaatgctcgctgagtatccatcaaacatagacgaactttagaactggcatcttcaagttccgttaattcagcaagggcatcatcaaagttatgctcacctttattttcaccctcatgagtactgagaaccacacggcttaatttttctaaatctgcatagatattctcaataacatctgccaactgctcaattttagtttcaaataggtcaagcagaagctcgtaagcattgccatctatcaattttgctcggcgagaacgcatacgatacaaacggaaagcgggtagatcccgttcacgcaatgtaaataaacgtccgtcccgaatagtaaaaccaacagtagcaatatcggcatagtcgtcatcatctaaacagtagaagaatgagtgtaaatgtaagccatcttcatcttcaaaaaaacgagcagaagcttctaagtcttccaattcgtgttcttccgcaagggtctgatctagtcgcgtctctaaaacaccacgttcttcatctgtaggatcaatcaaatcgatccaaatagcttcattaaattgattttgaatattttcatctacactgactaggcgatcgttatttaacgaaaaagctctgatcatttcatactcctaaaaattggatatgaggcgatgaacaaaaaggaacaaaatataagatactgataagaattaccgacgctcatcggcaaagaggttttggacgaggtgggttaaaaaactgataagtatcgactgtgactgtccaaaatgtgtatcctcaaagtgaaaaaaacgggcgaatggtacagatttagaattgagccgtcaaggaaaatgacattatttttagatggagaacaatgccttacatctgaacaggcgctattattcaagattgcgataacataaagttttgattaaaatgcacgccaacttttatatttaggaacagacaatggcagattggaacggtgaatatatcagcccttatgctgaacacggtaaaaaaagtgaacaagtaaagaaaattacggtatctattccgattaaagtattggaaattttgactaacgaacgcactcgccgtcaaattcgtaatttacgccacgccacaaacagtgaattgctttgtgaagcgtttttacacgcctttacaggtcagccattgccaaccgacgatgatttaatgaaagaacgtagcaatgaaattcctgaggaagcaaaactgaaaatgcgagagctaggaatagatccagataagtggcaatattaaatgatttcaaacctctcaactgcgaggttttattttagctaaaaaataggaggactatgaaggtttctaaacaaatagatcgtgaagtgcgttgggcattatatctgacgctattttatgttatgggttgggtcggttttgcttatttttcacctgcagggcgaggttttttaggctttcccctctggtttgaattaagttgtgtctatcttccaatcgtattaacgttattgatcagcgcagtagtaaaatggatttatcaagatattgatttagggggaaaagatgaatcttgagttgttgttacctttaatcgcctatctcattttcgtatttggcgtagcctattatgcctatcgccaacgtacaagcggtagctttttatcagaatattacgtcggcggacgctcaatgtctggttttgttttggcaatgacaacggctgccacctatgttggagcaagtagctttataggtgggccaggtgcggcatacaaatatggcttgggttgggtcttattggcaatgattcaagtgccagccgtattgctctcattaggggttgttggcaaacgcattgcgatgtttgctcgccaaaacaaaagtttaacgatcaacgacttgttgttaacacgttatcaacatcgctttgtggtgtggattgctagctttgctctattgctctctttctttgcaatgatgaccgtacagtttatcggtgctggacgtttgcttgaaactacgcttggcatttcctacggcaccgcgatcattatttttgcggtcactgttggtatttatacctttatcgggggctttcgtgccgtcgttttgaccgatacgattcaaggcttagtgatggttgtaggcacattactactgcttggcggtgtaatttatgcaacgggaggcgttgatgctgcaattacccagttagaaaatatcaaccctcaactgactgcaccttatggtattgatgaacgtccactagacttcacctttatgacatctttctgggtattggtctgctttggtctaattggattgccacattttgcagtgcggagtatggcatataaagatagcaaggctttacatcgagctttgattattggcactgtcgttgttgctgtgttgatgtttggtatgcatttagcaggtgcgttgggacgagcggtgattcccgatctaaaagttgccgatcaagttatcccaaccttgatgttacaagtacttccgcctgttgttgcaggcattttcttagctgcaccaatggcagccattatgtcctcaatcgactcaatgcttattcaatcttcttcaaccctgattaaagatctctatctcgcaattaagccacaagcggttgaaaatgaagaaaaaattaaacgtttctcgacaatcactaccctagtgatcagcgttttattggtgatcgcagccattaacccacctgaaatgctcatttggttaaacttactctctctgggagggttagaagcgacattcttatgggtaattgtattgggactattctggaaaaaagcgaatgcaacaggggctatttgttcaatgattgcaggtttatcaagttatgtgttaatgacaagcctatctatcaaaatatttagctttcacgccatcgtgccagcattggtaattggacttattgcttttttagtgggaaatcggtgtgtaacattaaaaaaggactagaaattattagctaataatactttttaaagagaaatgccttttcatatagcttaaagtcttataataaaagactttaagctatttttattctatgagccatttttataagtaacgcttagacagataaaggtattgagattaaaccagaaatgtctgatatgtatcttcaaataaggataaaaggacacagcgctattaaatatagcactcagcccttctattaaaaagtctagcttttagtgtagatcaaattgaagttctactagagtaaaacattcgctaatactaagccaaacactaagctaaatgccatgcttaataagcctgggatcataaagctgtggttgaaaatgaatttaccaattttggttgttccagtcgtgtcaaagtcaatagacgcaatgattggaccgtagttaggaacaaagaagtaaccgtttactgcaacgaataccccgattaagattggtgctgggatacctaacgctacacctaaagggaatagagttgctactgttgcaccttggctgtttactaatacagaaagtacgaacaatgcgaacgcaaatgcccatggtgcagtttccactaagcctttcaccatatctttaacttcggtcatatgagcgtccattaaagtatcgcccatccaagcaataccgaagattgcaataaccgcacgcatacctgcgtggaatacagaaccttgtgtaatcgcgttaccatttggtttgcagataagcataattaatgctgcaacagtaagcatcacgatttcgatagtatgagccattcccattgctttgccgtcgaatactgggcgtaactctttgaatgtacccataaacacaacaagtaatgcaccaaataagaataaacctacagaggttttagccgttgggctaatttggatctcagctgggtttgtatctgcgtgatttcttgccacatactcaggatcttgtaataaacgttgataattagggtcgtcttttaactctttacccattttatttacgaataaacacgcacagaaaagacctaaaatcgtgcctggaatggtcactaataaaatgtcaccaatgctataaccttgtggttcgatcattgcagcaacagacactaccgcggcagcaatcgggcttgctacaatagcaaattgtgatgcaataacagccattgaaagtggacgttcaggacggataccgttatggcgactaacttctgcaatcacaggcaatacagagtaagcaacgtgacctgtaccagctaagaaagtaaatgtccaagttaccgctggtgcgatgaaagtgatgtgttttggattacgacgtaaaatgtttgttgcgattttgatcatatagtctaaaccgccagccgcttgcattgcagccgctgcagaaacgacagccataatcataaacataacgtcgattggaagacctgcaggttttaagccaaatccaaaagagaggattgccaaacctaaaccgcccattacccctaaaccgataccgccaaggcgagcaccgattaaaatacagagtaatacaacggcaaattcaataagaaacatagcagacataatttgctccattgtaatttaacgaaaaagccctcatactgaggaagaattggcgattgttcgccctttatacaaaaggcgtgcaatatagcataaaaatttataatcgttataatctagatcaataaaaaattctaatactaggaaaaattatgcagttttcaaaaatgcacggacttggcaatgactttatggtgattgatggagtaacgcagaatgtctatttaacggaagatctcattcgtaaatgggcagatcgccatcgtggtgtaggttttgatcagctactactggtcgaaccaccctatgatccagaactagatttccactaccgtatttttaatgctgatggcagtgaagtctctcagtgtggaaatggagcaagatgtttcgctcgttttgttaccttaaaaggtttaaccaacaagcaggacattggtgtgagtaccgcaaaagggaagatggttttaagcttacaagacgatggtcaagttcgcgtaaatatgggggaaccaatttgggaacctgcacaaattccttttaccgcaaataagtttgaaaaaaattatattttacgcacggatattcaaacggtgttatgtggtgtggtttcaatgggcaatccgcactgtgtgttacaggtggaaaatattcaaaccgccaatgtcaatgaattgggggctttacttgaacgccacgaacgtttcccagagcgtgccaatatcggttttatgcaagtcatcaatcgaaatcatatcaaactaagagtgtttgagcgtggtacaggcgaaacacaagcctgtggtagcggtgcttgtggggctgttgcggttgggattatgcaaggcttattggatagccgtgttcaagtagatcttccgggtggaaccttgcatatcgaatggcaaggtgtaggttcaccgctttatatgacaggtgacgcagaacatatttatgatggggctgtgaagtcataagttatagaatatgagatatattggaataaacggagtagtttaagatccaaatatatattctggtactacaggcataaactacactatcgttatgcttttatgaactatagtcccaatcttcttgagattatctagcttggttttagtttactatttcagaataaagataattacttttggatgaataacccgcaatattctattcatcctattggagtattactggaatactttgtaggaacttaaaaaatattgattgtatctgagcaagggctttttcatgataaattatgatcttgttcaaattttaagtaaattttctacaaatgaagcaaatctttctttataatgatcgtcaatgaagttttatttcaaatttgactttttctaggaggatttatgcgtttagtgcctttggattgtgctgaacaagtgagccgttgggctgctcgttatattgtagataaaatcaatgctttccaacctactgcagaaaagccttttgtacttggcttgccaacagggggaacgccacttcaaacttataaagaattaattaagctgtatcaagcaggtgaagtgagttttaaacacgttgtcacctttaatatggacgagtacgttggcttaccgccagagcacaaagagagttaccactattttatgttccataacttctttaaccatattgatattccagtagaaaatgtgaatatcctaaatggaatggcggaagatgtagatgctgaatgtgaacgttatgaagcaaaaattcgctcttatggcaaaattcatctctttatggggggggtgggtgttgatgggcatattgcctttaatgaacctgcttcatcgttaagttctcgcactcgcatcaagactttgaccgaagatacgttgattgcgaactctcgtttctttgataatgatgtcaataaagtaccaaaatttgctttaacagtgggggttggtactttgatggacgcagaggaagtattaattttagtcacgggttataataaagcccttgccttgcaagcctgtgttgagggggcggtaaatcatttgtggacgatcagtgcgttacaattacatcgtcgtgcagtcgtggtttgtgatgaacctgcaacacaagaattgaaagttaaaaccgttaagtatttcaagcaattagagcaaaatatagctcgctaggaggaaaagatggggcgttatacactaacaaattgtgtgatttatacgggaagtgatgtgctatatcaacatgcggtgatcgtcaatggtgagcagattgaggctgtggttcatcaaagtcaagttgcagatggggttcatcagattgatttagagggcgcaaatctttctgctggttttattgatctgcagttaaacggttgtggcggtgtaacatttaatgaagatattagtgttaaaacccttgaaattatgcaagaaactaacctgaaatcaggtacaacaagttatttgccaacctttattacttcgcctgacgaaggaatgaaacaagcggtgcaagtaatgcgtgactatttggctaaatataaaaaccaagcactcggtttgcatttagaaggaccttatttaagtgtggcgaaaaaaggggttcatcgccctgaatatatccgtgaaataagcggtgagatgttggattttctttgcaaaaacggtgatgtcattacgaaattaacactcgcagcagacaacccaacggcagatcatattcagaaatttgttgaagctgggattattgtgtctatcggacactcaaatgcgacctttgccgaagcaaaacgacgtattgagcaaggcattggctttgctacccatttgcataatgctatgtcgccgatcagctctgggcgcgatggtggagtagttggtgcagtgttggatagcgatatttacgctggtatcattgtcgatggtttgcacgttgattggagtaatgtgcgtattgcgaagaaagtgaaaggcgataaattggtgattgtaaccgatgcggttgccccagctggtacaactgatatggaatattttatctttgtaggtaagaaagtttggtacaaagacggtaaatgtgtcgatgagtgtggcagtcttggcggtgcggcgattacaatgatcgagtcgatccgtaatatgatgcaacatactgatcttccgttagatgaagtgatccgtatgtgtacattatatccagctcgtgctattcatgttgaagataagttaggatccattgaagctggcaaaattgccaatttaactgcgtttaatcatcagtttgaggtattaggtacagcggtgaatggaaattggaagtgggctcatctctaatgtgttgagcgagcttaaaaagatcgtttaaagatccttctctaaacgatcttttttgtttgtttttgaagaatttcaaatttttctcaatttctcgcttgctctcatttgagtttttgcgtagaattgtccacctattttatatgaatttgagagtgccaaacgcatagcgataggcacatattagcggagtaaatatgtacgcagttttccaaagtggcggcaaacaacaccgagtgagcgaaggtcaagttgttcgtttagaaaaacttgaagtagcgacaggtgaaaaagttgagttcgactcagtgttaatggtcgttaatggtgaagatgttaaaatcggtaccccagttgttgctggcggtaaagtagtggcagaagtggttgcacacggtcgtggcgaaaaagttcgcatcgttaaattccgtcgtcgtaaacacagccgtaaacaacaaggtcatcgtcagtggttcacagaagtgaaaatcactgggattcaagcataatttcagaggagatcaagtagatggcaactaaaaaagctggtggttcaactcgtaacggtcgtgactctgaagctaaacgccttggtgttaaacgtttcggtggcgaatctgtattagcaggtagcatcatcgttcgtcagcgtggtacaaaattccacgcaggtagcaatgtaggtatgggtaaagaccacactttattcgcaactgctgacggtaaagtaaaatttgaagtgaaaggcgagaaaaatcgcaaatatgtaagcattattgctgaataatcttcaaaagaataagattaaaatgccccgctaatcaattagcggggttttttattaccattgaaacaaaaaaatttatgtcaaaatcacaacctttactcggttttctctttgctctaactgccgtaatgatgtggggtatgttgccgatagccttgcagcaaattttgaaatttatggacgctcaaacgatcgtctggtttcggtttattactgcaatgatagggttgtttttgattttgttctttgcaaaaaaattgccgaaagtgaccgctttcactcgccgccattattatctgctattgcttggggtattcggtttatcctgcaatttttatttgtttaatttagcgttaaatcatattccacctgcagccagccaagtgattagccctttttcatctttgattatggcgtttatcggtgtctatttgtttaaagagagcttcggtttacatcagaaaatcggctttgttatcgtgctgattggcttggggttattttttaatgatcgttttgacgatcttgctcagatgaatgaatatgcttggggaatgatatgtgcagtcagtgctagtctgatttggatctgttacagcattgctcaaaagatgatgttagatcggtttaattctcagcaaattttgctgtttatttattgtggttgtagccttgttttcacgcctttagcggatctttcacaggtcaatgatctcagtggctttgcactagcgtgcctgatcttttgctgtttaaatacggtgatcgcttatggtagttatgccgaagcattaaatcgttgggaggtgactaaagtgagcgtaatgatgccacttatcccgatctgtacaattttattttcgcagttggcattttatttaagccctgaacattttgctgaacctgattttaatcacttaacgcatttaggggcagttgtcgtggtatgtggagcaatgctttcagcggctgggcataaacttttttatcgacataaacggatttaatatgaaactacaacgtccattacttggattttcattagccttgcttactgcaatgatgtggggttctgtgccgattgcagcacaaaaagtgttgagtgttgtgaatgctcaaacgctcgtatgggctcgttttattgtggcagcaatcggtttgttactcattttaggctttacaaaaaaattgccaaaactgaccgctttcactccacgttttctttggttaatcgggttaggcgtggtaggcctatcgctgaactttttcttgtttagctatagtttaaactttatttcaccgacaactagccaagtattgtggcaattggcgccgtttacgatgattttatgtggtgtggtgatttttaaagaacaatttgggcgacatcagcaaatcggcttgctattgctcattattggtttaatcgccttttttaatgagcgttttgaggaaattttccagttaggcacttatgcttttgggttgcttgtcggtgcaggagcagcaattgtttgggtggtttatgcgatagcccaaaaaataatgttggcaaaatttagctcacagcagattttgctgattatttatacgggctgtgcattgctactcacaccatttgccagccagataaacatagatgaatttgatccgtttttattgggttgtttcattttctgttgtttaaataccttgattggctatggggcatatgccgaagcattaaatcactgggacgcatcaaaagtaagtgtagtcacgattttagtcccgatttttacgatggttttttcaagcattggacattgggcatttcccgatacctttgcaagccctgatatgaatttattgagttatatcggcgcatttattgtggtgtctggcacgattttatcggcggtcggacataaattagttaaaagaaaataagcatttccctagtttgtatgggaaataggagaagatatgaaatttattgacgaagccctgatccgagtggaagcaggcgatggtggtaacggctgtgtcagcttccgccgtgagaaatttattccaaaaggtggccctgatggcggtgatggtggtgatggcggtgatgtctatttaattgccgatgagaacctaaacacgcttatcgactaccgttttgaaaaacgctttgccgcaggtcgtggcgagaatggtcgcagtgcgggttgtacaggacatcgtggtagcgacatcaccttgcgtgtccccgttggcacccgtgcgattgacaatgatacccaagaagtgattggcgatttaaccaaacacggtatgaaaatgttggtggcaaaaggtggctatcacggtttggggaatactcgctttaagtcatcggtcaatcgtgcgccacgtcagaaaaccaacggcacaccaggggaaaaacgtgatttacagttagaattgatgttacttgcagatgtgggaatgttaggtttaccgaacgcaggaaaatccacctttattcgtgcagtatcagcagcaaaaccgaaagtcgcagattacccattcacaacccttgtgccaagtttaggagtagcacgagttggtgcagatcgtagctttgtggtggcagatattccaggattgattgaaggtgcggcggaaggtgcaggcttggggatccgcttcttaaaacacttagagcgttgccgagtactcattcaccttgtcgacattatgccgattgatgagagtgatcctgcacaaaatatctctattattgagtcagaactctatcaatatagcgaaaaattagcagataaaccgcaatggctggtgtttaacaaaatcgacaccattggcgaagaagaggcgagagaaagagccgaagcgattgtagaagagatcggttgggaaggtgattactacttgatttctgccgcaacagggcaaaatgtatccgctttaacccgtgatattatggactttatcgaagcaaatccgcgtgttgaagaagaggaaaaagcaaaagaagaagtcgcattcaaatgggacgactatcatcaacaagcaatgcaaaacccgattaccgaagatgattgggacgacttagatgatgacggttggacagaagaagatgatgaaggggtggagtttatttataaaccctaactttaattgctggaatattttaaattaagggatgggataccatcccattgcccttaattcataattgttagataatataggtggttacaagttttgatttaggacaaataatgagtgatatcttagtgcctcttatttttacagatgctgctgcaaaaaaagttaaattcttgattgaaggcgaggaaaacccagagctccgtctacgtgtttatattacaggtggcggctgtagtgggtttcagtatgggtttacttttgatgataaacttaatgacggcgatttaaccattgaaaatttagatgtagctttagttatcgatccaatgagtctccaatatctaattggagctactatagactatgttgaagggttggaaggctcacgttttgttgtgcaaaatccaaatgcaagttctacttgtggatgtggggcctcatttagcatttgagtattattccttccaattattaattcccttaactaaagtggcagtgtcttaacagtagcgtcatctagttagcaaaaaatataaccctttcccacagataattcggtattcacaaagttgtgtggataacaattaacggcatagtagacaaaagtattggttttaattattttccctaattattaccaactctttttatttaaaaatcctttataaacataatcttacgctttttcgttaatccgctatgaaccgataatttctgtttcagttctttaaataacccttccaacctatttgttgttttttctatatttaaatgagtatattcttcaaaagtgagtttaaagccttgtactataaggctttagcccactttttaccaacacttttgtctactatgcaaaatatcctatctaaatcaccgctttcattagatttccgcctattatttctaacttttattgataaaagttgaaaaattcttgttattttattcttagttttgtgtaactcttgttttttttttttttttaactaatgggagggttcatttgtgcatcctgaaaatgtaaataaaggtttacgatgttttattaggaaaaacagtagagaaggttattatgaataaaatatttagagttatttggagtcatgctcaacaggcttgggtggttgtgtctgagttagtaaagtcttataccaaaacatccacttacacggataaaagagctcaagtatgcacctcagattattttttagataaacagcaagataaatttaaattaagtcttttaagtctagtattactaggtatattttttagtccatcagtaggttcaaatccatttattcaagctggttctactaatgtagcgcctataaatgacaacggtgctattggtattggttatgcgagttatgttgggaatagttctgttgctatcggtaagtattcaaaagctagagatactactgctgttgcggtaggtttaagggctgaatcaatcggacatcatgccgtagccgttggagcgcacactgaggcaagttcacgctccgctgcctatggttatagcgcacaagcattaggtagaagttcggttgcggttggtgaaaatgccgtgacaaatagaggtgctgctagagcaaccgcacttggtaataataccgttgtcagcgtgggtggcggtgtggcattgggttatggttctaatgcaagtacagctggcggtgtagaggggttaaaacaagattattcagttgttactggggcgaaatcggaagctaatggctttaaatcaacagaaaaggttagtaataatgctattggtgcggtttctgtgggtaatgacaacatcaaacgccaaatcatcaacgttgcggcaggtaaagaagatactgacgcagtaaacgtggcacagcttaaatctttaacgatgaaaattgcaggggatacaggcaattctgataatgagaaagtgggtatttggaatggtacgcttaaagtgctaggtacaagcggtgagattagtacctctgcaagcaatgacactattaccttgaaattagatgatatgttgaagaaaaaaattacggactctgctagtaaggaatatgttgataatgtatttaaaaatgtgaaggttacaggcggtggacaagagtttaccgttggtaatggtgatacctcgactcaaaagattacagtcaatactgatgcaggcaaaaaacattttgatattaaaggaaaagatggtgttactacgactgtagttgggcgtgctgtggaagtaggattaacaactgaaacaaagaataaaatcaacaaaattgataacctagaaaccaaagtaaataaccaaggtattactttcaaaggtaataccggtcaaactaattcaatcaaactaggcgatacgctgaaagtggaaggagtaaccggtgaaactgaggtaatggcttcaactgataagttggcgttgggcttagccaaaaaagtgaaagatgagattgccagtaagatgtcttcgttcaaaattaaggcgaacagtgaagcgaatgaagaaacgatttcaaatgacaacactattgtctttaaaaatggcaaaaacattaatgttacccgaagcaataaggaattgatctttgcaaccgttgcaacacctgaatttactagtgttcaatatggcaatagtggacctaagattaccagcaccggcggtaatctaaaagttacaggtgcagacggcaatacaccagttaaaatcgccaatgttgcagaaggcacagaaataaatgatgcggtgaataaagggcagttagataatgccactgtgacctatttccacaccaatacaggcgaacaatcccaaggcgagggtgatgaaaataccaataaaggtaagatcacggacaaagcaggggcgagaggaaagcactctgtaacagctggggtaaatgctaaggctgagggggaaaattcaattgcgatcggttatgaagccaaaataagtgctcaaaatgcagtagccattggagcgaactctaaggcaggttcacactccgctgcctatggttataacgcacaagcattaggtgaaaggtcggttgcggttggtgaaaatgccatgataaatgatcgtgctgctagagcaaccgcaattggtcacaattcgattgtttccgttggcggcggtgtggcattgggttatggatctaatgcagatagagcaggtgatattgaaggggcaaaacagtcttattctgtaacagtagcaagcagtgtcgataacggctttaaatctacaggaagtgttgataacaattctattcctattggtgcggtttctgtgggtaatgtcagaatcaaacgccaaatcgtcaatgtggcggctggtacacaagataccgatgcagtaaacgtggcacagcttaaatcgctcaccatgaaaattgagggaaatgagaataagcataacggtgcaaatgctgatttaaacagtgctgacagacctaaagtcggcttgtggagcgatacacttaaagtgcttggtacagatggtgagattaagacttctgcaagtggcaataccattaccttgaaattagatgaaacattgaaaaataaaatcactaatctagatagcaaagtgactaagttggataaagatggtttaatggttaaaaccagcactgcaccagatgcgaaaaccattgaagttagcaaagatggtattaaagctggtgataaaaaaattaccaatgtggcggagggtacgataagcggcacatcaacagatgcggtgacaggtaaacagttgcataactttattacagcaaataataatgttgtgaataattcaggaagtgtgaattttgcagacggcaatcatacgaagatcgacactcaaacaacaggcacaattaaggttaatgtaacaacgggagcgtttgttaatccaacaacagatggaaaactttcacaacaaaccgcaggcgtagcaacaattgaaaatgtgtctgcggcggtgaatgctggttattggactgcgaaagtaaacggtaacacggaagttgccaagattaaatttggcgacactttggactttgtcgatggcaatgtgacaacagcgagaatgtcagaggctggtaaagtgactttcgatgtgaaagttgatgatagcagtattaagattgttaatggtaagttggtttcaaccttaaaagcacctgaaacaacaacattaacggtgagtgaagctaacgataataccaagggcaaagtaacagatgttgccgaaggtgacaaaaataaatttgttacggcagacaacattgcgacaacgctaaataaaataggctttaatgtggaaagtggcggtaatctggcaacgggtaatgcagacggcaaacagctgattaaagctggtgatacagtaacctttaaagctggttatggcttaacggtgaaacgtgagggcaataactttacttatgctctgggtagtactttgaccacggataagttcacagcgggtgaaaaaggcgagaatggcaaagagggtaaagatggcacaatcggcgtaaacggcaaagatggttcgtctgtggtgattaatggtaaagacggctctattggcctgaatggtacgaatggagagaatggcgtcaccattaaaggcggtcaaggttctgctggtgttgatggggctgatggtacaacgaagactcgtattgtttatgaatataaagacccgaacactaatgagatggtgacagaaaaaattgccacattgaatgatggtcaaaaatattcaggtgataactatgcagagaataaagcagagacggttatcaagaaaaaactgaatgaaagattggaaattaaaggtggagcaacggaagtgagcaccaataataatatcggtgtgattgctgaaaacggcgtgttaaacgttagattggcgaaaaacattgatttaggtgctgatggttcggtaacaacgggcaataccaaagtagataacaatggtattaccattaagaaacctgccaatgctggtgatgggaaatctgatgtgaaactgaccgctaatggtttggataatggcggtaacaagattatcaatgtggcagctggtgtagcagataccgatgcggtgaatgtgaaacagttgaaatctgcgaaaactgaagtggaatctaccgatcacagtgtggtgattaaagagcgtcagggcgataatcagcaaatcgtgtatgatttggcggttgctaaaacgaaactcactgcctctaaggataaacgcaccattagtgcagcagataaaggcaaccattttgcgacaggagatgaagtcgcagtagcaattaataccgcaacagcagccgcaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctgtggcgatggctaatttgccacaaatttctttaccaggtaaaagtgctatttctgtttctaatgcacaatatcgcgggcaatctgcctatgctataggttattccaaaatttctgataatggcaaatggcttattcgagcgtctgttagcagtaatactcagcgggatactgcgattggaggaggggtaggttttgtgtggtaatctagcacctataaattagaatttcatgctcaatgccattgttattttaacaatggcattgtttggcatagtagacaaaagtgttggtttttctgcaaactatgtctctaatggtcaaaagtgttggttttgaccctatcccaaattctgtgtaaacacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaacggaatcatccgtcgggaatacgtttcgttttttaatcacgcgacgaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcgcgagcctgtgcttccgtcggggcttgataaacctgctttaaatctgcggtgacggctttgtaatctttccacgaaacgaatttcaagctgttacgcactaaatgcacaatgcaaagctgaatcttcgttttagataaccaagatggtcggtcagttcatcatttaacgcggcctcgacggtaattttcttgagcatccgtgaaaactgattgaggtcttccggtgtttttagatttttggcaaattccgctgccaaggcgtgaagttgtttttcgttcataataaaatacctgtgtctgaatgtattatctcagaaacaggtatttacacaaattgtgggagaggctctctatccgctttttttgttcacagattttatccctcagcccccatccccttcgctaacgctcagggacttcccccataaatgggggaagaattttgatctgcccccaaaaagttagactgatttagttcaaggactgagttctgtattccacagggcttagtcctttcaatcttacttgaatacgctcatgattgtaataatgaatatattcgtgaatagcttgttccagttgctcaaaggtctcaaaccgtttaccaaagtaacattccgtttttaaacgcccgaagaaactttccattgcactgttatccaaacaatttccctttctcgacatactttgtacgatgccgctttgcttcaatatcgactgataacttgccattttattgtctttttcagcaagatgataaaagaacgtactccgttttaaatcaaccaattgcaataaaatctcaaacggaaattggtggcgtagttccttcacgaggtgtgattatactgattaatccaatatcttaatatggtttccttaacctgaaaatactgacgagttaatgaccgatttttattatgttgaagataaaattcgatcacttgttgtttaaaagattgggtgtatttagccataaaaaatctgcaccttaattagttggttgtttagtccaacttttggggtgcagatcacatcgacccgcccctaccattatctttgcttataatgcatctcttcactcaccgcccttaatttttcagcggcttgctctggggttaaatcccgttgtgcttcagctaacatttcatagccgaccataaatttccgtaccgttgccgagcggagtagcggcggatagaaataggcgtgaagttgccaatgttcaatatcttgcccatctttaaagaacggagcaaaatgccagcccattgaataagggaaagcacattcaaataagttatcataacgacaagtaagctttttaatcgcaagggctaagtcatctttttctgcttcgctcaattcgctcattcgtttgatatggcgttttggcatcaaaatggtttcataaggccacgccgcccaatatggcacaacagcaagccaatgttctgtttctgtaacagttcgtgtgccatcttttagctctgcttgagcataatctaccaataaatttgagccgtgttgttcatagtaacgacgcaaatttttatccttggttgcaatttcattcggtaaaaacgagttcgcccaaatttgcccgtgtgggtgtggttgtgaacaacccatcatcgcccctttattttcaaaggcttgaacccacaagtaatctttacctagctcttctaattgagcattccaagtatcaactacaccacgaattttttccacaggcaattcggggagcgttttactgtgatcaggtgaaaaacaaatcaccctagctaaaccacgtaccccttgaattttaaacaacggattgtcagatggcggagcatctggcgtatcttgcatcaaagcggcaaaatcgttggcaaatacataagtgccttgataatcagggtttacatcgcctgaaacacgggtattggtcggacagagaaaacacttttcatcataactcggtagctgttcaaccgccgctttatccacttgaccgctccacggacgtttcgctcgatgtggagaaactaaaatccactcgtctttcaatggattataacggcggtgcggatgatcatttaactcaaatttctggctcatttggagtatcctttcaaaaagttaaaataatgtggagtatagcgtaaataatacaaagaagatatgaactagatcacaaaatgggatcatccactcattcttgaaaagaaaaaagctaaacccatacgggtttagctctactactcaaataaggtctgcttagcaattacatcattccgcccatgccacccataccgcccattccggcacctaggtcagctttttcttctttcggcagatctgtcaccatacattcagtcgtaatcattaaacctgcgatagaggctgcaaattgtaatgcagaacgggttactttagttgggtctaagatacccatttctaacatatcgccgtattgttcagttgcagcgttatagccgtagttaccattgccatcttttacgttacgagcaacaacagacgcttcttcacctgcgtttgtcacgatctggcgaagtggtgcttccattgcacgaagtgctaaacggatacctacgttttgttcttcgttatcgcctttcactacatcagccactttgcttgccgcacgcactaatgccacgccaccgcctgcgatgataccttcttccacagctgcacgggttgcgtgaagcgcatcatctacacggtcttttttctctttcatttcaacttcagttgccgcaccgactttgattactgcaacaccgccagccaatttagccacacgctcttgtagtttctctttgtcgtagtctgaggttgagtcttcgatttgttggcggatctgtgcaacacgagctttgatttgtacttcatcgccaacgccgtcaatgatggtggtattgtcttttgaaatcaccacacgttttgcttggccaagctcttcgatagtcgctttttcaagttccataccgatctcttcagagataaccgtacccgcagttaaaatcgcaatgtcttgtaacatcgctttacgacgatcgccaaagcctggcgctttaaccgcagccactttcacgataccacgcattgtgttcacaactaaggttgctaacgcttcgccttcgatatcttctgcgataatcaataacggtttgcccgcttttgctactgcttctaatacaggcagaatttcacggatatttgaaattttcttatccactaaaagaatgtatggattttctaattctaccgtgcctgcttctggtttattgatgaagtatggcgataagtagccacggtcgaattgcataccttcaaccacatctaacgcatcttctaaacctgtaccatcttcaacggtaattacgccttctttgccgactttttccattgcttgagcaattaatttacccacagtgctgtctgagttcgcagaaatcgtaccgacttgttcaatctcttttgacgtttcacacggtttagagagcgattttaactcttcaacaactgcagctaccgctttgtcgataccacgttttaaatccatcgggttcataccagctgcaaccgcttttaaaccttcatttacgatagcttgagcaagtacagttgcagtagttgtaccgtcacctgctgcatcatttgctttagatgccacttctttaaccatttgcgcacccatattctcgaatttatcttctaattcgatttcacgagcaacagatacaccgtctttagtgatcgttggtgcgccaaaggttttgtctaataccacgttacgacctttcgggcctaaagtcacttttactgcgtctgctaatacatttacgccctttaacattttcacacgagcgtcgttaccaaattttacatcttttgctgccattttttattccttgtagggacacactgcgtgtgtccgtgattaatttgtaaaaatattgaatgatttaaccgcttgttgtagttggacacacgcagtgtgtccctacacagttattcaacaattgccaaaatattgtcttcagaaagaattaatacggtttcaccgtcaattttttcttctttcacaccatattcattgaaaatcaccacatcaccgactttcacatttaatggtaacacagtgccattatctaaagtacgaccattgccaacagcaatcacagtaccacgagtagatttagttgccgcagagccagttaaaacgataccacctgcagatttagtttcgatttcttcacgttttaaaattactttgtcgtgtaacggacgaattttcattgaataactcctcattattgtaattagaaataactatagtaatagaaagtaattattagatctctatctggaaatttcaagggggaagagaaaaattttgttaatatagtctaggagatattgattgacgtactctccgctataaaaggcgagaattcctactagctcctattgttctcaataggctacttcgtattgctcattttaccaagtcaacgcccgattaaacacaaaacgagcagaaccgcagaactgtttaattctgcggatttgatgcctgctgcggtaatgcgcccatttcgattattcgccaatacatcaagcaacaacaaacacctgcttagttaggtttgaaacggctcacaccgtttgtgccttatatctccatccttcaggacggagtttgacggcacagtcccgataaattaataatagctctaagcccttttccacccttcacattgtatacattatccatcgaaatatagtaaccatgcaactctgcaatacgtcttacaatcgacaagcctaaaccgctccctttttcattctgcccagcaggacggtaaaaacgctgccccagtttagcaagatctgcctcatcaacaccaccaccattatcttccacgataatacattgtggctctaatgtaatacgaatggtcgtaccttgagggcaatattttattgcattatctaccagatttcgtaacatcaaggaaagaagtaacggctgaccttgtttaaccgcaggtacgcctttttgttcaaactcaatttccatctctcgtttctgtgcttggaaataaagctcccccaccaatgatggaattaatttatcccaatgaatatcttctacaccttccaattccgttaaattatctaaacgggataacgtaagcagttgctcgattaattgagttgcacgattaatcccttgagtaagattatgcaagactttctcacgtaaagcggtatcatctccagctaattgtgcaatttcggtttgaattttcagcgcggctaacggactgcgtaactcgtgagcagcatcagaagtaaagcgacgctctctaagcaacattgttgaagtccgatcaaaaaactgatttaaactgctgactagcggtaaaatctctttcggaacatcagtcgaaagcggactattatcatcaggcgttcgctgttgaacttgctcccccacacgttgcaatgtcaatagttcacgcttaatcacccacacaatcaagcccaataataacggcaaactggcgaaccaaatccacatttggctaaacaccattccttgaaccagatcatctcgataatcttgctcttgaccgaccgccacaaaaaaacgatcacctataggtagccaaaaaattcgccactcgtcttcatcttcgtgattaagtcgggatttggtaaaaccactggctcttttaaatggaaagtttgcaccattatgcccgtcgctcaatatcctttccccttgggcattaaagatagcaaatgccagagcatcatcatcgaaagcgatctttttaaaagattttttatggtgttcgccgttgaaagtccgttgtggcttacgttccatcaataatgtgcgtaaatctgaagaggccaaacgttgagcaaacagcacctgttgagcatcaaacacttcatcaacttcgtgacgaacttgcacccacgccactgcagtggatataagccaaataagcaacgccgtgcaagaaatcacgatcatcaagcgaaaacgcaaactggtatttttaagcaacttcatcgttttttcctaaggcgtagccgacaccgtgtacggtacgaataaactgttttccgagtttctgacgtaaattgtagatatggacttcaagagcgttgctactgacctcatcgtcccaagtatagagtttctcctcaatgaaagaacgggtgagaacacgatctttattgtgcataaataactcaagcaaattgtactctcgtgtggttagcgtgacttcttgctcccgaagaaacactttgcgttgatttggatcgaacttcactaaactatgttcaatcacagggttggtatgcccataacgacgacggatcaacgcctgtaaacgagctacaacctctgcgagagcaaaaggtttacagagataatcatctgcaccacgttgtagccccgtgatacgttcatcaagggtatctcttgcagtcaaaataagcacaggcacatcttgattagcccgccgccaactttgtaacacctcaagtccgtccatttttggcagggtgagatcgagaactacggcatcataaggtgcggaacttaacgcatctaagccagttttaccgtccgtgaaccagtccacactaaagccggatttactcaacccaagttttagcccttctccgatcaacggatcgtcttcaattaataaaatacgcatctcaacctccaaattctaaaagagaaaagtggcatttactgccactttcctattatcgcattaatttaccttttcaacacgatgaacatcaacttctgtaccgactagtgatttatcaatttcaccataaagtctgatttcatcatttggggtaacatttagccctctccaagcatcatcgtcaatatccaccgtgatctcaccgcttgcgtcacggaatgtgaaattgtctttatccaactgcttaaccaacttgccttgtaatacgacatattgatcatcgctcattgaagatacttggctggcttgagtaaccgcttgctgactattagtaaaaccaccattttgataataacctttgtccgcaaatgctgaaaggctaacggttgataaaagtaatgctgaaagtaaagtaagttttttcataaattgctcctagtgtttattagtaaaagcattattgctttgttgagtgtattaaaacagagaaatcttaagaaagtcttaagataagaaaatttatttttagacaaaatctaataaaaaagcggcaagattcgtaaatcctaccgcttagatcacattatgaaaaaattagaatctatagtttgccccaataatgtactgacgaccagggtttatatgtgaatgcaaacgttggctatgactttgatatcgtttatttccaatattattaatagcaaagtcgagacttaaatcatctttgagtaatctcagattagcataaatatcgtgtactccgtagccagctttacgaattctttcatcgccacttctagtcgtaatcacaaaggttttagcttctgcataacgccctctatatcctatctctagatttggattctcaaatgtataggaaagagttgttttccattggcgacctttaggtacaatatccaaaacaccctccgaaagtttaaagccttcaggggtagctcttgaataacttgctccaacaccaacttttagccctgcaatttcataagatgcttcggcatcatatcctttagttctaagattgccaagatttgttatagtaggagcagtaactccggagtaataattcgttactttttcatcaaaaaggcttgctacaagtctagctcctgaatgtttccattcaaaaccgacttctgctagacgtgattgttcaggttttagattactatcaacatctctccttccacgaacttgtgctaaatttgcacggttatctgttatagtattagctgtggctaatgctggggaacggctggcataattcaattttgtctccaatgccaagtttgaggtgatattccaaattacattcaagataggattaactttcccctcagaagcatgaattttagtactatttgtttgcctaatgtatttaagctgaaatggtcgtagcgaacgtctgttgttaaagtaactttctgaattgcccaaatagcgacattaaaactcctattaggtaaaaaccaagtaaaacactcagaaataattataaataagaattattatcatttcaaataaaatttaatagaataccgagaaaataatagaaataaaaaacccagctttcgctgggttcttaatataagtaagcaaattatttgatttttgcttctttataaacaacgtgtttacgcacaactggatcaaattttttgatttccattttttctggcatattacgtttgttttttgttgttgtgtagaagtgaccagtttcagcagtagaaactaatttgatcttctcgcgattacctttagctgccatttgttagctccttagattttttcgccacgagcacggatttcagctaatactgcatcgatgccttttttatcaataatacgcatacctttcgctgttaagcgtaaagttacgaaacggttttcgctctcaacccagaaacggtgagtgtgaaggtttggaagaaaacgacgtttagtcgcattcattgcgtgtgagcggttgttaccaactactggacgcttgcctgttacttgacagactctagacattttcaattctccgatattacttaagcttaagctaaatggttcgggcgatcagaaaggctcaactcaatctgacgacctcgtcaggtacatacacccgacccacagactattttaaagactgcgaattatacttgctttagttcatctaaacaagggggaaattcgtaattttcctgttcaaacttttcttcttcgaacgaaaaatagtcacctttgccaacaataatatgatcaacaaagcgaatatcgactaaatcacacgccatttctatttttcgagtcaaaaaccgatctgcctcacttggattgcagttgccagatgggtggttatgtgcaactaaaatggcggcggcattacacttcaaggcttctttaatgatttcacgagggtgaactgaggcttggttgatcgtaccgtaaaacattttttctgttttgatcaacctattttggttatctaaaaagatcaccataaatacttctcgctcccaagattccaattccgattgaaaatacattacggctaaataggggctatctaccatttcatttactttcatttgttgcgataaatagcgtttcgtcatctctttggttgcctgaagttgaatatactgaatttgtcctaatcctttgattttacagaaatcttctaatgttgctgacagcaatccccgtaatgaaccaaaggcagtgagtacgctttccgatagatccatcacgggtatccctttaattcctgtacgtaaaaagattgccaatagctcagcatcacttaaggcttcagcaccaaatttcagcaatttttctcttggcattaattcactagaactttcattcatattttttgttcaattagttaaaaagtgcaaacagcataaaaatcttctcaccttgattcaaaaggctttttctcttttttcgacaaagatcgcaaaaatagggcgttgtgagtgagtacctatttgcgtaaaatagcaagtagaaaacccatcataaagatgattcgttatgttaaaagataaaaaaatccttatcggtattactggtggcattgcggcatacaaaaccattgagctaattcgtttattaaaaacggcaggagcagaagtgcgagtggcaatgacccctgcggcagaagcctttgtcacaccgctgacattacaagccatttcaggtaatgcggtttcaacctctttactcgatccccaagcggaattagcgatggggcatattgaattggcgaaatgggctgatttagtggtgattgcccctgcaacagcagattttattgctcggttgcgtatcggaatgggcaatgatctgctttcgaccatttgccttgcgaccgcttcgccaattttgcttgcaccagcaatgaaccagcagatgtacaagcggtcaattgtgcaggaaaatttgcaaagtttgactgagcaaggtgtttcgatcattggacctaacgctggctttcaagcctgtggtgatataggcaaaggcagaatgtctgagccgagtgagatttttcaagcgattgaagatcattttacgcaatcacaagatcttgctgatttgagcgtggtgattaccgcagggccaacgcgtgaagcgatcgatcctgtgcgttatatcagtaatcacagctcaggtaaaatgggctttgcgatagcggaagcctttgctaaacgtggggcaaaagttaccttgatcgcaggccctgtcaatttggctacaccgcaaaatgttagccgtattgatgtgatttcggcacaacaaatggcagaacaagcggtcaatttagtacagaaaaatgcgatttttatcggctgtgcggcggtggcagattaccgagtggaacaggtagcagaacagaagattaagaaaactggtgataatgatgaacttactttaaaactggtgaaaaatcccgatattattgcaacagtagcccatcttactcaaaatcgccctttcgtggtgggatttgctgcggaaacgcaaaatgtggctgattatgcgaaagataagttacaacgtaaaaatttggatttaatctgtgccaatgatgtatctggcggacaggtgttcgggcaagatcaaaatacacttcatctcttttggcaaaatggcgagaagatcttacagcttgcagagaaagggaaattggcggaaaagctggtggatgagattgtagaacattaccgccatctctaaggaacgaatatgaaactacaggtcactacatcttataccattgaagaaggtatttttcctacttttgtgaaaggcactgaaatcaaagcgcttacaccttgtcggaaatatccgaattggtatgcttgtgaaattgagggctatcacacttatgtgcctgaacattttgtccgagcgaatcatttagtgaccgattacaacccaacggaattggcggtagtgaaaggagatattgttgaattactggagcttcattatcaatgggcattagtgagtaaaggcaaagaaatcggttggttgccttgtgaaatcttggtaacaagcggtcagctttagttggaaatttgtaaaaggaagaataatgaaacaaatcgacttaaaaattttagataaacgtatcggcacagaatttcctttgccaacctatgcaacaacaggttcagcagggttagatttacgtgcattgattgagcaacctttaaccgtagaagctgggcatacagtgttaattccaacggggatttcggtttatatcgctgatccaaacttggcggcggtaattttgcctcgttcagggcttgggcataaaaacggcatcgtattgggtaacttggttggcttaatcgacagcgattatcaaggtccattaatggtttccctatggaaccgtagcgataagccgtttactgttgaagtgggtgatcgtatcgcacagctcgtgtttgtcccagtggtgcaagcacaatttaacattgtagaagagtttactgcgacagatcgtggtgagggtggatttggtcattcaggtaagcaataggattgaaaatgacagaacctgttatcaaaatgccgaaaaaatcggtaaaagaacgccagcaacaagtgctagaagtcttaatcgggctacttaactcggaagaaggtatgcaacgtgttacgaccgaaagattatcaaaagcggtcggcgtatctgaaggggcgttatatcgttacttcccaagtaaaacaaagatgtttgaggctttgattgaacggattgagatgacattaacgagctatatcaatgcaagtaaacgccaagaaaataccgaattggcagtaaaagcgattttacaaactatcttagaatttgcacaaaagaacccaggggtgacacgcattctaacaggacatgcattaatgtttgaagatgagttactcaaagctcgtgtcgcaaaattctttgaaggattagaactgcaatttatgaatttattgcaaatgcgtaaattgcgtgagggcagggcttttgctgatgaacgagcattggctggttacttggtgaatttctgtgaagggcaatttttacgccttgttcgctcaaattttggctttaatcaacatcaacattttgaaaaacagtggcaactgattaagccattgttctactaggaaaaagatgattatcccttggcaagaacttgaagaaagcaccctatataatgttttagattcttttattttaagagaaggaacagattatggggagcgagaactcacgctcgcagaaaaacgagagcgtttattagctcagttaaaagccgataaagttgtaattgtttggtcagaattgcacgaaagcattgatattaaagataaaaaatctttcttagggaatttgtaaatttatgctaaaattcttgacgtagtattaagctatatcaactataaatgatttatagaggtttctatgcaagatgtttcaatctcaaccgcacagcttgaagatgtcagcccattaccatccattcacgatccttcggtggaatggtttttaactcactgtcatattcatcgttatccagcaaaatatactttaattcacgcaggtgaagatgctgaatcactgttttatattgtcagcggagctgtgtctgtctttattaaggatgaagaaggcaaggagatgttattaaccaatttaggacaaggcgaatttgtcggtgaaatcagcctttttgaagaaaaggctcagcctcgcactgcttgggtaagaactaaaggcaactgtgaaattgctgaaatttcttataaaaaattcaagcaattagttcatctaaatcctgatatcttaatgtatctctcagctcagatggctcgccgtttacgaatgacatcaagacaggttagtaaccttgcattccttgatgtaacaggccgtattgctcaaacattgatgaatttagctaaaatgcctgatgcgatgactcaccctcagggtatgcaaattaaaattactcgccaagaaattggtcaaatggttggttgctcacgagaaactgtaggccgtattttgaaaatgcttgaggatgaagggttaatttctgcacatggtaaaactatcgttgtgtatgggacaagataacatattaaaaatgcaaagtgctacgttagattatcaaatcaattaatctaacttagccttaaaacattaagatttccccctaattattagccccataaaaactttagtctatacaccacaaaaaacctctctaagcctcctgattgccttgctacacatcattccgcttgactaccccccttaaaatacaatatatccattttggcaaacggtttcggaattcctttttctttgacaaattaaggtttaactatgtactcctctattcctttatcactcactaataaaactctttctgcggcttcaggtaaaacttatcatcttgttgataaatcaggagaaccccttaaagtctttttcactaaaattgttgatgaacaacttgttattagaagaaatcagggattgttagatattatagctttagttgggaatatgaaatgacggaaggtacccgtcaatcgattaagactgatgcccatagggcagaacaaatatccttagtagtggtggatgatggtgttactctacaggtgccatcaggagtgatttctattgccgcgacagttgtaaaaggaaatacgaatgttaccgctattggctcaggtagctatgaatataccattgcagttggatacagcaaagaagcagactttattcctgatgttgatcgatatgtgagtattgtttagctggtgtgtattcccctcgctagcccccatccccctcgcaagctcggggacttcccccataaatgggggaaggtgcccgaagggcggatgggggactcttggaagtttgtaaaaccatccctaaatagaaattttcctaaccaactgccgtactaaatcaggaccttgataaatcatcgcagaatagagttgcaataaacttgcccccgcgttgattttttcttgccctgattgcaccgaatgaataccgccactgccgataataggcagtttgccgtttaattcttgagaaagttgcgaaataagttgagtacttagagcattcaacggcttaccacttagccccccttgctgatccgcaaaaggcaagcctgcgacgctatctcgtgaaagtgtagtgttgctggcaatcacagcgtcaatttggtgatggacaaggctgtccgcaacagaagcaatttcttcggcagtgagatcgggggcgatcttcaagacaagcggtttataaaccccaaatttttgcgaaagttgggcttgttcggctttaagtgagcgtaacagatcgtcaagtgcttcgccgtattgtaaagaacgtagatttttggtattcggcgacgagatattgaccgtcacataactggcgtgtggatagactttgcgtaagcaaatttgataatcgtccaagctatgttcgataggggtcgtcgcattttttccaatattaatcccaagaataccgttatattttgccttttttacattttcaatcagcacatcaaccccaagattattaaatccgttgcggttgataatgccttcggcttcaagaatgcggaactgtcgtggacggggattgccgtcttgtgcaacaggggtgacagtgccgacctcaataaaaccgaaccccaatttagcaaagccatcaatcgcctcgccatttttatccgcccctgcggctaaaccgatagggtttttgaaacgcagccccattacttcggtcgggttgtcgggaagtgaacaagctaaagaaaacggggttttaccgaataattttaaggattgaattgcaagttgatgggcgttttccgcatcaagattaaatagtgcttttttgataagtgggtacatcatttgtatcaatataaaattacaattcttccctcgcttgagggaaagaaaattcttcccccgcttgtgggggaaggtgcccgaagggcggatgggggagaattaaatatcctttttccgccccatccccttcgcttcacgaagggacttcccccactttatggggaagaattaatttttctttctaaaaatcaatgccatacattagaaatcaaaaacccaatctttcgattgggcttttgattaatggctgaacattgcagaaatagactcttcgttgctgatacgacgaatagcttctgccaacattcctgataacgttaatacacgcactttatttaatgcacggatctcagccgaaagtggaatagtgtctgtcacaatcacttcatcaagcgcatcattcgctaagtttttcgccgcactgccagagaaaacagcgtgtgttgcataagcaaatacacgacgagccccacgctcttttaatgcttctgcggctttaaccaatgtgccgccagtatcgatcatatcatcaactaagatacaatcacgatccgccacatcaccgataatgtgcattacttgagccacattcgctttcggacgacgtttatcaataatcgccatatccgcatcatttaataattttgcaatagcccttgcacgcaccacaccgccaatatcaggtgaaaccacaatcggattaactaaatcggttttctttaaaatatcttcgattaacacaggcgaaccgaaaacgttatccacaggcacatcaaagaagccttggatctgttctgcgtgtagatcgcaagttaatacacgatccacccccacacttgaaaggaaatcagcaaccactttagcggtaattggcacacgcgctgaacgcacacgacgatcttgacgagcataaccaaagtaaggaattacggcggtaatacgacctgccgaagcacgacgaagtgcatcaaccattacgatcaactccattaaattatcattcgttggtgcacaggttgattgcacaataaaaatgtcccctccacgcacattttcattgatctgtacttggatctcaccatcactgaaacgacctactgttgcatcaccgagagaaatataaagacgttcagcaattcgttttgctaattcaggagtagcgtttccagcgaagagtttaatatcaggcattttggataaacctctagatgtagatttttaaggatataaattgagcgtttgatgtaaaagggaaacatttctgccttgtgccacaaagccatcaacattttcaggttttaacgcaaacacacggcgagcctcatcttcacaatcaaattcggcaaacacacaagcaccagtgcctgttagccgagacggtgcgtattgtaccaaccaatttagtagatcatcaacctttgaatacagatctcggacaattttttcgcaatcgtttgcgaaaggggcatcaagcagttctgctaaagtacgttttggagtatcacgagttaaatcggggtgcttaaaaatcgaagcggtcgcaatcgcctcatcgggctttaacaccacataccacttctcttttggctgacaaggcgttaatttttcaccaactccctcagcaaaagccgcaatacctcgcacaaaaatcggcacatctgcccccaaggttaatcccatttcagcaagttgctcaagggaaagccctgtttgccaaagtttattcaacgcaactaacaccgtcgccgcatttgacgaaccgcccccaacacctccgcccatcggcaagcgtttggttacgccaatgttcgcccctaacgagcaagcggttttttcttgcaacaattttgcagcacgataaatcagattttgctcaacagccacaccatcaatctgcttggttaagcaaatggttggatcttggcgaagttcaatctcaatatcatcaccaaaatccaaaaactgaaatagcgtttgcaattcgtgatagccatcagaccgcttacctgtaatatacaaaaaaagattaagtttcccaggacttggaaaagtaaaagtagccatattagtacgcccaatgatcaatacgaattttcaaggtttgagaaccattttccaacacaatcaacttaggcagatttggcgggcgatcttcgtgatattccacaaaacgaactttccacaacgtcccattgaccgcataatcaaattgagccaactggcgtttttcattgacaatatagtttgactgttgctcaggctgccccttcacccaataggcaaattgatctatcgggaacgaaacgccgataatttcttccattaacatagccacatctgcttcggtacgagaacgcccctcgctgtcagaaatcgtcattccataagcattacgctgtaatttcaatgatttgcttgataaatttgaggacatcgttagcccaaagttcgtcggggttttatattgccaatcaaaatgggaagaaaaacgttcctcaggggaaatatagccaaattgccctttcgccgagtaggcgttgatttgcgttaattgtgcaagatgttgttgccattttgcatcattatgtggaattgtcacactaggttgagtgatttcagtcggagcatccagtacagaatgacaaccagcaagggcaaataacagagtaagggatagcagttttgtgagttttttcatacaatcctcaaatttgaaagttataatagtctcaataatatactatgaaactacaatcaaattattttaagaaaatatttgatatttactaaaaatggtgtgagatctacccgcttgtttttagctttcgccctgctcccccgtcggctttctccgtttaccaatattcttggtatctttgtggcggactttcacttttttcttcaagctctcttttttctcttctttctttttcttaatccgcgctttctcttttttcgacaccgtattcacctcaccatcttttggggctttggtgcgtggtactaagccttcaataatacgtggttttaacggctcttccgtataacgtttaattttgccaagcagtttataatcgtgagcttcgactaatgagacggctgaacctttcttgcctgcacgagctgtacgcccgatacggtgtagataagtatccgcactatatggcaggtcaaagttaatcacaaaatcgacatcatcaatatcaatcccacgagcagccacatccgttgccaccaacacatttaccacgccgtcttttaagcgagcaatcgcttgattacgttgtgtctgtgccatttcgccttctagataagtcgaacgaataccacgtttacgcaaggtttcgcttagctctcgcacactttcacggcgacgaacaaacacaatgcttcgctcaatctcaaattcacttatcaaacgggcaagtaatttggttttatgttcaagattatcagcgtgataataccactgctgaattttcttacgctcacggcgacttggctctgcgtcaatctgaacgggatcatttaaaatgcgttcagcaaaatccactaacaattcgccttccaaggtggcagaaaagagccaagtatatttacgccaacgggtttccgctgcaattttttcggcatcttgcccgaaccccatttgcaacatacgatccgcttcatcaaaaattaaaatctcgacagaacggcaatcaaaattttcttcttgaatatactgttgcaaacgcccaggtgtcgccaccacaagatcttgattggtgttaaacacttcgccgtggttttgataagcgacaccgcctgtaatagtggcaattttcaagttggtaaattgtgccaactcttccgcttgctcagcgacttgcatcgctaattcacgggtcggcgttaaaattaaaatgcgtggcggaccaggcttacggcgtgggtgatcgagcaaatgttgtaacgccggcagtaaaaatgcagcggtttttcctgtgcctgttggggcagaacccaacacatctcgcccttccattgcaggcggaatggtttcttgctgaatagccgttgggcgtttatagccttttttttccaacgcttgcaacagctcagggcttaaatctaattcttcaaaggtgattaattcgttcattttgttctcttgttaatttttaagaaaatcagaccgcttgttcatttaaaacttgtctgagtaatgttttgtttattggcacaacgccaagctgtaattcaaaggggcgtaacacctgattgataatatcaatactgtaatttcccttatcattttctaaatcagataacgttttgcgagaaactttgacaatctccgcataacgctcttgtttcattgccagtagatgtaaacgtagatatttcaacgcctgccctaaactcatctcattgagcaatagcttacgagcaatttcgtctcgcacagtcgctctctgataaatatctaacgtttttttacttttagaggctctcgcctgtttgatctcttccattatgataataattgccaacgttgtaatttttcaggtaaatagtccaaactgattgaagggtacgtcaaaatcgccgttggaacgccccttgcttctaaacgtgctttaagcccgacaagctgttgagccgtttgacgcaaagcatccaataacttgtcggctgaacataaatcatcaagctgttctgcaatcagatcaaaacgatattcaccgcctaattctaatgcagggtgacttttactatcccacattgtcgtacgaggaatgccttcaggatccgctttcattggggcaaaatcataaattggagcaagccaaatacgattttgattgcgtaagaaagcggtatttcgcccgtgattatcgctatttccaaaggcgatattcaataaatctcgccttacccactcgatcacaaaagcctgtttatcaaaagccattcctgtttcaactaggtgagaattttcaattttggcaatcaactgacgaataaccttttcgtgatccagcaaagagccagcccctttttctaacatagcataaacagattcaacggcatatcgagccattttcccctgttcattacgataaacatcaaagcgaggtaaccataacgacgggtaacgttcgccctcttccaaccgcatttttgtcgtatcaatggtatcaaaacccattgaggctaattcgtggtaatagtgaaattcagctctcaatatgtcgcaatctattgcactgcgttttccacgcggaaacttgactaaatagaaatcgtcggcagcgtcaccttgttgtagattatcaatccaaacttgctgagtggctgtttggcgtagcaataatttcggcgcttcgccaccagcccccgttgcaccgccagccattgccccacgctgattagcatattccaaaaaatcagcttggcgattgataacatcatctatttcaaataagcgagggggttcattttcgataaaagaactgaccgcttgcttcactcgtaaatgcccgacaggtgcaatcgtaccttgttttaataacaaatagttttgttgagctgtcggcaaatgagcaatatcaagtttttgcaaccaataacgccgacttgctccagaaggaactatatcatctaaaaatgcaaaccagcccgatacactacggtatgggaaaaactccacaggatagttaaatgaaactgccttatcattatcacttaaaatctctgctaaatcatagagatagctaaaatcattgaggctataatcagcctgaaaggtcaaaatagcaatatcctgccaacgatcagcaatataggcctgaagtgtaagcggttcgatttgcataaaaattctctacggtaaaaaatatcacgcattataaacagaaaaaggattttgtgatagttataagttacacaaaatccatttttgttacttggcgagagatatatctctcattataaatataacgccatcaccacagcattctctcgcccaccgtcttgggttgggtagtaatttttccgcaccgccacttcattaaagcctagtgagtagtaaagtttttgtgcagtcgtgtttgaagctcgtacttcaagccataatgtcgtgatctgtttttgttgaagctgagcgatcaacgcttgcaacagttgcttaccatagcctttgccttgataagcaggatcaactgcaatattaaacagcgtgacttcatcaagcacaaactgacaaatcgcaaaggcaacaatgcggttttcaacggataatttcaaattcaaatagcgttcgccttggctgtttaacagcgtccctttcgcccaaggcactaaatgggcttgttgttcgatctcaaaaaggcggtcgaagtcgttttctaaaataggttctatcacagaatatccttaaaacattagtgatgtaatgaattatgtgttattgggtatcactttttcacaagcttaccaataacttattgttgatacgatagaaatttgcctctctatctatttctgctgcccatttttcagtgttgtttagcgttgtcttggctgtttctatagagctacaagcggtggcaacggaaatattgcaaataaaagatgaatagcaaattttttcatataaaaaaactatttattgtttaattaaaggataaggattcacagccccagtcggtgtataaataccgtaatgcagatgaggtggagtacctttggcgttaccactatcaccaacagtgccaatcacagctccttgctcaatccattgatgacgttttatatcgccatattcttccaagtgagcatagtaatgtaccgtccatcccgtcattacgctgaccacttttccacccagtttgttttgtccgccacttcgcattccgtgccaagtatctgcaaaccgttgattgggaacaggattgggtaagctttgttctgttggtgttccttgcagtaaagtaggaagccaacgtgcataagcgtagaaataaggtggtttgaaaagataaatacaggcaataaagaaactgaataatattcctaaaactgtaatctacttaactaatgttttcattttattctgccatatctttacaaaacagttgcatctgttgccaaagctctcgcttttgtgtagcttgggaaagcatttgccaagactcacactgccaagcggtctgatttgcaaatttttttgtaaattgtaccgcttgttcttcaggttgaatcagccagaaaatcggttgatgatcgaattgcagacgcattgcttgctcaaggctaatccattgatattgctcgtgatttaattgcaaggctcgtaaaacatcttgaaataacccagtctgttggtgatcttcttcgcaaataactaccagctttatattgtccgccaagcgaatttgtgcatcgcctttgagtacttgcggtttaacaagtatccattggggtatattcatttctgttagaagcagatctcggcgattcatcatttttcctcataaaaagttggggaatagtagcaaaaatcggtaaaatgcagaaattattttgcattaaatttggaaatttatgttatcaatcgaaagtgaagtgcttgaacgccatctgagcgtctttgagcaaaaaaatgtattgttatttggcgatgtgcgtgatgatttttcgggactcattcagccgatggcaaagtctgtggcggtgttcagtagctattttgattatgctcgccattataataacgtggaatttggcttggaatgttatcagcaagcagacttagcagtcttttactggacgaagaataagcaagagtgtcaatttcagttgttacaatggctggcgactgcgtcagttggtcaagaattattggtggtaggtgaaaaccgtgtcggcgtgcgttcagtggaaaatttacttgagccgtttggtgagatagccaagattgactcggctcgtcgttatgggttgtaccattttaggctggaaaatgtgcctacttttgatagcaaaaaattctggaaatcttaccatttgggcgatcttgatgtgtttgctttgcctgcagtgtttagctcggcagaactggataatggttctaaattgttgctttccaccttcaataaagccgatggattgaaagggaaggtgttagatcttggctgtggggctggggtgattggagcgtgcttaaaacagcaattcccgaaaatcaagctgacgatgtcagatattcacgcaatggcattggaatcaagtaagcgaacactggcggaaaatcagcttgaaggtgatgtggtagcaagtgatgtcttttcccatattggcgggcgttttgatctgattgtgtcaaatccatctttccacgacggtgtagatacggcatatcgtgcggtagaagagttgattgcccaagctaaacaacatcttaaccgtggtggtgagctacgcattgttgccaatgcttttttaccttatcccgatttattggataaggcattttgtagacattaagtgttagcgaagtcgagtaagtttaaggtgtattcagcgagagtctaataaagattagttaaattagttgttaaaattcagcagctattttaaagatctaacgaaattcagttataattccatcaactttttccattgacctaaaacaatgacccaaacaacctatttcgccaccgcagcgcgtggctttgaagaaatgttaaaaaccgaacttgagcagattacgcacgcacaatgcaaagtggctcaaggcggcgtgcatttcaccactgatttaaaaggggcgtatcaagcgttattacatagtcgcttggcttcccgtattttattgcccttaatcaatacgaaatttttcagcgacagcgatttgtatgcgtctgtggttgcttacgactggcagagcattttcgatccaagagatacctttttcgtggattttaacggcataaaccgtgaaattcgcaacacacaattcggtgcaatgcgagtgaaagacggcattgtcgattattttgagcgtaaaggttttgctcgtccgacagtggataaaatccgtccagatattcgtttacacgcctatttaaaccgtgaagaattgattatttctttggatttaagcggtgaggccttgcatatgcgtggttatcgtgaagaaacagggaaagcaccgttgcgtgaaaccttggcggcggcgattgtgttgcgttcaggctggcaaaaaggcacgccacttgtcgatccgatgtgtggttcggggactttgttgattgaagcggctcaaatgcaagccaatatagccccacaaattaaccgtatccattggggatttgatagttggaaggggcatcagatcgaactgtggaaaagggtttggcaggaagcgaaagagggggaaattctgcccccctctgccttcggcacctcccctcgcgagcagggggaggaaagcaaagtgctgttcttcggctttgaccttgatcaccgagtgctacaaaaagctaaacagaatgcgaaaaatgcaggggtggcagatttaattcagtggcaacaaggcgatgtgtcggcgttgaaaaatccgattgcagagcaggtggggacggtgatttgtaatccgccttatggtgaacgactaggtacaacccctgcgttaattgcgttgtattctgtctttgggcaacggttaaaacagcaatttgcaggttggaatgcctccatttttagtggcgaacctgaattactgaactgcttacgtctgcgttcagctcgtcaatttaaggcaaagaacggaccgcttgagtgtgtgcagaagaactatttgatcagcgaaaatgcagacaagcggtcagatcttgatgaaaatctgcaatttagccaaaacgcacaagttgcccctgattttgctaatcgtttaaccaaaaatatcaagaagatcgaaaaatgggcgaaacagcaagggcttgatgcctatcgtttatacgatgccgatctaccagaatataatttggcggtggatagatatggcgatcatatcgtggtgcaagagtatgccgcaccgaaaaatattgatgaaaacaaagctcgccagcgcttgcttgatgcggtatctgcgaccttgtatgtcactggtgttgaaacgaataagttagtcttaaaagttcgccaacgtcaaaaagggactaatcagtatgagaagctggcgaataaaggcgactatttcttcgtgaatgaatatggggcgaagctatgggtaaacttgacggattaccttgatacaggcttgttccttgaccaccgcttaacgcgtaagatggtcggtgaaatggcgaaaggaaaaaccttcctaaatctgtttgcctacacgggttcagcgacggttcacgcagcgttaaatggagcaaaatcgaccacgaccgtagatatgtcaaacacctatctcaactgggcggaacaaaatcttgagctgaacaatatttcactacgaaattaccgcttgcatcaggcagattgcttgcaatggttagcggattgccgtgagcgttttgaactgattttcgttgatccgccgaccttttctaattcaaaacgaatggaaaacagttgggacgtacaacgtgatcatattgccttgatgaaacagttgaaacgcattttaacggcaaacggcacgattgtattctcgaacaacaaacgtggctttaaaatggattttgacggcttggctgaattaggattaacggcggaaaacatttcgcacaaaacattaccgttggattttgagcgtaatccgcatattcataactgctggattgtgaaacattcggaataaattatgttagatattgtgttatatgaacctgaaatcccacaaaatagtgggaatattatccgtctttgtgcaaactgcggtttccgtttgcatatgattgagccacttggctttgcgtgggatgataaaaaattacgccgctctgggctggattaccacgagtttgtcgatattcaaaaatataaagactttgatgattttcttgagcgagcaaagcctaaacgcctttttgctttaaccaccaaaggcgagcctaatcatagcgatgtgcagtacgaattggggaattttctgatgttcggccctgaaagccgtgggataccgaaagcgattttagatagtttaccaatgtcacaaaaaatccgtatcccgatgtgtaaagatagccgtagtatgaacttgtctaattccgttgctgttgtggtgtacgaagcgtggcgacagtttggttatcaaaatgcagtgccaaggcaagagatttgaattatcagtgtaatagacaaaatagttgctaaaaagtggctcaaagccttatagcacaaggctttaagccctcttttttgaaatatgaacaaaaaactgcccattttgccaaagtcagaaaataaagaaacatgatatacaaaataatactcaacgttatttttgtaatgaatgttataaaacgtttatcttaaaatctaaattagatccaattaaaatttggactgattacacatccggaaaacaaacctatcaacaacttgccgaaaaatatcattgttcggttagaactattcaaagatatattgataaagcccctaaaacagctttaaaaccaactttaaatcgatacttgaacatcattatggatacgacattcttcggtcgttattttggtgtattagtgttgatggattcaaataacgccatttctcattattttgtgcgaaccgaaaaagatatttactacaaacttgctctgaataggttaagagaaaaggctatataattcaatcgattacctgtgatggtagacgtggtttgatgaaagattttatttatctactatgccattttggcacagtacaaaaagcaaaaaccgcaagctatctctaacctgcggttcttctctttaataaaaccccgacgatgctctactctcacatggggaacccccacactaccatcgacgttacagcttttcacttctgagttcggtatggagtcaggtgggacaactgcactattgtcgtcgggaaaatcttttgatgattctctctatcttcttttttctgttctttaagggcaaatgtaatttgcccctacatctttctgttctttaagggcaaatataatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggacgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcttacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttccggcgaacgagtttttcactcgttttatcgttacttatgtcagcattcgcacttgtgatatctccagcatacttctcaatacaccttcatcgacttacacaacgctcccctacccaacagacgtatcacaaatattcctctgatttctatccgcactttatgccaactcaacgtgttgggtgcttgaccaacatcttattccgtttcacttcattcgatgttgttaatcgtaaggcgtatttgtgatacgcctgatgccgcagcttcggtgctatattttagccccgttacatcttccgcgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccactgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacaaaaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaaccatacaacctcaaacattttcacttgaagttgatattaactactaaacacttgactgcttttgttcagtcaagatttttcttactactcagactttcttgtttcagggcaaatgtgatttgcccctacagaaaatctctcagttttcagcttgtttccaaatttttaaagaacattcgataatcacttatctttcgacaaaaaatcatctttaaatggcgtccccacggggattcgaaccccggttaccgccgtgaaagggcgatgtcctaggcctctagacgatggggacaacatttaaagatgctttccttcatcctgtcaatttgcaaattttatcgcaaatctgaccgcttgtgtctgttttcttgctctattccttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcgccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacactctcatctctgaaagcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaactggccttgcggtcccagtctttcatctcccgatactacgcggtattagctacagtttcccgtagttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaagtttaatcgctcaatatgtactgactataaaaaaatcacgactgaatttattcaatcattatgaatttcaagttaagcacctatcaagacttcaaaattaaaaaaatatttttaaacaaagtcaatcaacaagtgcccacacagattgtctgataagttgttaaagagcaaaaaagaacgacgcactgtcaaatttaactacttcacaacagcgcgtcgttgtgtggtgcgcattatagagaaattcaaaaccaacgcaagtacttttttgcaaaaaatttgaaaaaaatgatcgcttgttcaaaataagctcatgatgtttattttaaaaacagaggttgtttatattttcacggacatatttacaaaatatcatacaaatatgctattagataacaaaaaggattagatccactcaaatagatctaatccttatggtatcaatttcatatcaccaattcacaggtaacttacttgtacaacttaaatatttagaaacgataggacagattggttccaatagcatttccctttaattttgtaccatttcgtttcaaattattttttgagtattctaaacctacttcaatatcattagagattgcatattttacaccaatcgcatatccaatccctttgaaactaccaaaatccgatattttactaatactataatgtaatttaacgtatggtaatatatctggtaggagacggtatccttgagcatatccaatactatattgggatttttgtttgatatcatgaaaaatattgctacttcctaattttgctttaccatcaattattccaattaaattcctaccataatctattgcatagtctaaagtaaagtttatgcctattgcctgcttaccttgtaaatcaccatttttatattttgtagttgtaacatccataccaattcccccacctgtaaaagtttcacctacaggcgcagctaaagcagaacttgataacaaagctactacgataaatcttttcatcataaatctcctattaagttagcgtagaaaatattattttattctaatgagatagatatatatcaaaccgatgttttttagtttccttacaaaaatcaggtttcttatttgctaaaaataatgcgtagttaggtctttttacaaccactctctttctagcaagttgctgagcagggaaaagtaaatcatctgaatctaaatcacagccaaccaattgttgaaatagttgcatctccttttttactaatgcacttttagtcttagacggatacataggatcaagataaacaacatccaccgagtcaagatctggatttaaaccagtaatagaactatgaggaagtaataccattctttctctcataaaatgaccaatttctaaatctttataagctctttgtaaaccatcttccaataatgcgccaacaattggattacgttcaataagtttcacatagcaccctattgatgccaaaacaaaagcatcttgccctaaacctgctgtcgcatcaataattgtaggagtatacgaacctttaacaccaacagctttcacaatagcctcattacgaccaccgccaaactttcgacgatacgacatttttccatcaacaaaatttacagctacagcacctaatttaggctgattaagtttccttaattcaaggcgttcattagtctgtactaatgctaaattagagctaggattatgcttcaatttccatttttcacaaatatcataaaagcgctcagtaaaatcactttcattaattaattgaatattcatatcatgaggtttaaatacaacataggaacaattctttgttcccatgttataaaattactttttaacacgagtgtgtaaccccttcttctctaaattacgataaatcaaccactgctgtgcaatcgtaattaagttagaggttaaccagtaaagtactaagcctgatgggaaccataggaaaaacacagtaaacatcacaggcataaagttcatcactttttgctgtactggatcagcaattggagtcggcgacattttttgtaacaagtacattgacccccccattaatagagggaaaatgtagtatggatcttgtgccgataaatcttgaatccaaccaaagaatggcgcgtggcgtaattccaccgcttccataaatgtccagtataatgcgatgaaaattggcatttgaagaagaattggtaagcaaccgcccattgggtttactttttcttctttgtaaagtttcatcatttcttgactcatacgctgacggtcatcaccgaaacgttcacgcatctcttgaatgcgaggttgtaacatacgcattttcgccattgaggtatattgggcttttgttaatgggtatagcatggttttcaccacaatggttacaccgataatagctaagccccagttagatacaatactttgaatgaatgttaatagccagaataatggttttgcaatgaaccacgcccagccataatcaacggttaagtcaaagttatttgccacttgtgccattgcagcttgatctttcggtccagtccataaatggcttataatagtcgcttcaccattaggggcaacttgtgttacaggcccacggtaaccgatagtgcctacgccatttcctgtgcgagtataaagattattttccgcatcttgatttgggatccacgccgatacgaaataatgctgtaaaacagctgcccaacctgctttagtatctacagataagttagcttttgccatttcatcaaaactatattttttatagttcacttcagaagatgaataagcaccacctgtataggttggcattgcaaaattgccagcactttcaactaaagtatgtttaagttgaccataaggctgaacttcaagggtttctgccgaaccatttttgatgtgataattcaccgctacattatagctaccacgttttaaggtaaatgttttggtataaactacatcatctttttcaaatgttaatggcacatcaatctcattttgtccttcagctaacgcaaatttctctgccgtagcttgatactgagcacgacctgctgtggtatcaatcccatttttaccgactaacccactttgtgccacatacagcactttgccgttatcttgtagcaattcaaatggtgtattagagtctaattctgcgttatattttaagagatcagaatcaaccacatcaccacctaaagtatctacggttaaacgtaatacgtccgtttcaatagtaatggtttttcctttagttgattgctcattgatagatgccacattagatgaagcggggacatcactcgattgatttgcaacttgttgtgtttgagcttgagccatcgcttgtttttgtgcttggatctcaggattatagtcctgttgccactgcgtaaaaatcaagaacgaaacaagcaacaaacccataatcagtaaactacggtttgagttcattttaagttctctgtggttaaagtgaagtggaatagcccactatggaaaagtatacattttaatataggataacaaactatccaacgccttttgcaagatagcggttggatttttttagagatttactaaaaagtactgcttcttgcaaacaaatgctcacaaatcaaacaaacttaggattttcttactaatattgaagcaaaataatgtgatgaacgccacattttgaagaattacttcttttttattcttacgaaatccgacaaaataagtgtcatctagcaagaaaactcgtataattacgatgtttttatttttttattcttacaagaggtacacacaatgggtggtattagcatttggaatctagttattatcgttttattagttgtcttattatttggcactaaaaaattacgcggattaggctcagacttaggcgaatctatcaaaggctttaaaaaagcgatgaatgatgacaaagctaaagacgctgaatttgagaaagtagaacaaaaagctacagaatctaccgaacaaaaagcaaaagaaaaagagcaggcataatccgtgtttgatataggtttttctgaattagttttggtgtttatcgttggcttagtggtactaggtccgaaacgcctgcctattgctattcgtacagtgatgggctgggttcgtactattcgaggattggcagctaacgttcaaaatgagctttctcaagagctaaaactgcaagagttgcaagagagcattaagaaagcagaagagttgaatttaagtaaattatcccccgaattaagcaagaccgtagaagaactcaaacaatcagcacagaaaatgcaagctaacttagactcagcaagagggcaaattgaaagcctgacgcaagagcaagttaatgaaattcaaaataaaattgagcaagagagccagcaactttctcaacaagctgaacagcagaaagaaaccgaaaacccaccgcttgaaaccgaaacgctttcagcggatcgcattgcagaacttgctgaagcagacgaggataaattgacggcgtattatcccccagatgacgatcttgcaagtgttgagcctaaaacgaaacaggataaataatgtcagtcgaagaatctcaaccccttattagccatttaattgagcttcgtaaccgcttgttaagagcggttatttgtattttagttgttttttgtatccttgtttattgggcaaatgacatctatacattactttctagcccacttactgaacgtttacccgaaggggcaacgatgattgccacgaatgtggttacaccgtttttcaccccgataaaattaacggcgattgttgcagtatttatttccgtgccttatattttgtatcaagtctgggcatttatcgcacctgcattatataaacacgaaaaaaagctagtttatccactgttaatctcaagctctctgcttttctatattggtgtggcatttgcgtattatgtagtctttccgctcatttttggcttcctgacccaaacagcccctgaaggtgttgtaatggcaacagatattaatagctatcttgatttcattttgactatctttttagcctttggtgtctgttttgaagtgccagttgcgatcattttactttgttggtctggcgtaaccacagcagaagatctcaaagagaagcgtccttacattattgtggcagctttcgtgatcggaatgttacttaccccaccagatatgttctctcaaacattactagctgtgccgatgtgtctgttatttgaactaggactactggttgctcgtttttatcagccgaaagatgatgaaacagagtcaacagcacaatctgaataaataactatagaggcacaaaatgtgtctctatgtattttagataatgtatattctgctcaatagccatctgctgtagtattcccacatagaatacctttaatcaccttttgagagccaatacattccgaaatcgaatattgattcaaatattgatagaaatgttcaagggcgtgatctaagacagatttcaggtgacaatgcggttttaaaatacacgcaggagaattgcaatctatcaatctgggattgccttgcaaggttctaatcacttcgcccacaggcatggagagaatgagagaggaaattctaataccgccaccttttccccttgcggtgattagccacccttgttttgccataaaatgcaccactttcaccaaatggttctgcgacacttgaagcgattctgctaactgcggaatggtgcgaagctcatcttgatgatgagcaagatacatcaatacacgaaaagcataatcagtaaatttacttaggtgcatagttccctccatacttgataaagttgggcattaatgcccaacttatctttcccattactcgtgagaggagagtaataaattccccaaggttttcaccccaatccccgttgcacctgctgcccataaatcacttgcagttttgcggaaggttgcagaacagtcaatgtgtaaccaattttgctgataattttccacaaaataggataagaaggctgttgcggtacttgcgcctgcaccaacaggaacagaaccgatattggcaatatttgcaaaggaagatgaaatttgagcacggtggaactcttcaaacggtaaacgccagaaaggttcgttttcggctttggctgcctcaaataaacgggcaactaattgatcgtccattgatagcactgaatggtagtcattgcccaccgctactttagctgcacctgttaaggtcgcacaatcgacaataaactgcggtttctgtttgctggcctcaattaaaccgtcggctaacactaaacgcccttctgcatcggtatttaacacttctgcggttacgccattgcgataagtaatgatatcccctaatttgaatgctcggctactcaccatattttctgcacagcaaagatagagtttcacacgttgttttaagccacgtgcaatagcaaaacctaacgcccctgtgactaaagctgcaccgcccatatcagtacgcattgtagacatactgtcacttggttttaagctataaccgcccgtgtcaaaggtaatgcctttaccgaccaaacaggctaacactggtgcatctgggttgcccgttgggttatagtcaagttgtaacatcgcaggtaaatgagcagagcctttaccgactgtccaaatgccgtgataaccacgttcatttaatgcttcacgagcaacgatttcaaaagaaaccttacctttgccgacatatttatcggcttggtgtaaaataaattcagctgctttgtgagccaacatttcgggggttaagcggtcagatggttcgttaataatgtcacgagtaaagctgctacacgcaaggcgagcatcaaattcagcttgttgctcatttaacgcaggataggttactgagcctgcattttttacactaacaaacccttgatgaaacgcccaacactgctctaatccccaaccttcgcctgttaaagccacatttaaaatgttttgatttttgattttgcgagccgcttgttgaatggtggctaattcatcttttaccaaatggattgtcataccttgatcgtttgccgataaaatcgcattttttccccaaacttcagaggcagcagttgatgataacgtgatttgcattgaactcataaagactccttgatatatagctatataaatacttttacacttcatccaatataactttgaatattgtcaataaagtattattgccaatcctactaaaccccctactaaaagtctatcgttcagttcactctaagatacattgtgaaaaaataaacacatatcacagatattattcattttttcaacatgatgtaataatcaaaaattgggaatgtatcttcaaagctaataacaagtaatgaatcaattaattttggtgatctcttaagagatcaccaagagctaaggatgaaaacgaaagtaaagaagagcagctcttaagccttgattataagagtttaatctatcttttacctctcaatccgcccaaacttcccactttgtacatcacgcatagcttggataatttcttctcggctattcatcacaaaaggcccataacctacaacaggttcatttaatggttctcccgtaagaattaacagtttagcatcgttattcgtctcgatctgaacatcagcaccgccacgttcaaaggtcactaactcaccacgacgagcaatgtcctcgccattaatttgtactgtgccatctaacaccaaaataatcaaattatggctttctggtacagcaaaagtatgggctttacctgcatttagtacaatatcccacatattaaccgggctaaatgtacttgcaataccagccgtacttgccaattcgccagcaataatgcgagctgttcctgcattattctcaagctgtaccacaggaatatctgccgatttaatcgcttgatattttggtgttgtcattttgtgagctttcggcaaattcacccaaagttgcaccatctcaaacattccaccttctcttgaaaaacgctctgagtgaaactcttcgtgcattacacctgaacctgccgtcatccattgcacatcacctgtcccaatagtaccgccaccaccataagagtctgagtgagcaacctcaccttgataagctacagtaactgtttcaaaacctcgatgtgggtgttcgcctacgccacgaaaatccgatttgcgtccaccatcaaaatggcgaggtggattgtagtccatcaataagaatggatctaaatttttatcggtatcgttatagctaaacattgattgaacgtggaacccattgcctacccagtgttttgcaggtgcagtatgaacatttgcaacttttttcattttgttatcctttgtttatagttaaatgttgcgagtgatttatcacatctctcttgatggggtgcattataatcttctctaaaatttgataaatatttattttattgattaactatttattataagcaaataataaaaagaaaaatcgcacaaaaagataaatccattataatgtcacctttcacagcggtacgataatgcaaaaatattgcaacatcttaccgcttatttattcaaccgtggttcgcaaacctcccacgcaaaaaaactaaggaacacaatgaaacctacacctaaagctgccgtgattttttcaggcggacaagattctacgacttgtttattccttgctatcaaagaatttggcaaagaaaatgtcgaagtcgtcacctttcaatatggacaacgccacgccatcgaattagataaagcccgttggattgcacaagatcttggcgttaaacagaccttaattgatacatcagtgatcaaagccattacgactaatgccttaatggacgatcaagctgaaattaagcagacaggcaacacgcctaacacctttgtggatgggcgtaatgcactttttctactttacacagccatttatgccaaaagtcaggggatccaaaccatttatacaggtgtatgtgaaacagattttagtggttatcctgattgtcgagatgtattcattaaatcaatgaacgtaacgctgaatttagcgatggattacaacttcaatatccgtacaccgttgatgtatctcacgaaaaaagaaacttgggcgttagctgatcaacttggggcatttgactatatccgaacccatactcacacttgctatcttggcgtagaaggcggttgccatacttgcccaagctgtttgttgagagaaaaagggttaaacgaatatttagaggaaaaaagcaatgtttaaaatcgccaaagaatttagttttgatatggctcatatgttggatggtcacgatggcaaatgcaaaaatctgcacgggcacacctataccttacaagtagagattgctggcgaattacatacggacggtgctaaatcgggtatggtgatggattacagtgatctcaaagtggcggtaaaacagcatattcttgacaaaatggatcacgcctttatctacgattcgacaagcgagaaagagtgtaaagttgccacattacttcaatctctcgattccaaaacctttggtattcctgctcgcaccacagcggagcagatggcgaaatacatttttgacacactcacaacggaaggactacctgttagtcttattcgtctatgggaaaccccaacgtcttattgtgagtactgccgataatgaaaaatccagaataccgaattgtcgaaatctttgaaacccttcaaggcgaaggattcaacacaggtatgccgagtatttttatccgctttggtaaatgcaatcttgcttgtccctggtgcgataccaattacaaccaatacgaaaccaaaacccttgcagatattatgcaagtggtcaaaggtttttccgcaaagaacatcattattacagggggcgaaccgacaattcagcccgatttagcgtatctgctcgataccttgaaagcagaaggttattttattgcaatagaaaccaatggcttaaaacccgttccgccacaaattgactacatcgccactagccccaagcggttatatcagaagaattatttgaaacatcacattccctttgcgaatgaagtgagaattgtggtggacggtgatgtgctagcgttttgtgagcagatagaaagcaccatcaaagcagagcgttactacctttccccttgtgaagaaaatggggtgatgaatatgttagaaaccatcacccaactaggaaaacttaaccagcgtccgaacaaaccccgttggcagttaagtattcagacgcataagatggctgggattgagtaatactgaaaacgcttaattgttgcaattaaactattctgctacttttacttcttttgtcccacaaccaaaattaataatctcttgctcagacataagaggataacggcattgcatttttagatagagaattccctcatctgatagagtgtcttgataacctactctagcctcttctggggatagccccgaagtgtcttgataacctactctagcctcttctggggatagccccgaagattcttgatgtctatttatactatattgtaacgatttaggtttactagatttctgagattctggctcattgatatcttgcgccaataatgaattttcattattgctatccacaacagaagcctgttcattttgaactgaaatagattgtctagctccagccttttcatctgatgaggaggcctctgttatatccttcttagaatcaggaatttttacttgggaagctcccgcttctgagacctcagattttagagattcaacttttggtgactcaacttttggtgactcaacttttggtgactcaacttttgatgcctcaacttttgatgcctcaacttttgatgcctcaacttttgatgactcaacttttggtgactcaacttttgatgcctcaacttttggtgactcaacttttgatgcctcaacttttgatgcctcaacttttgatgcctcaacttttgatgcctcaacttttgatgcctcaacttttggcgactcaacttttggcgactcaacttttgaatcttccgcttttagtccttctacatcagctttatcttctcccttttcttgaataatatccttcttaggttgttcaaagcaggcagttacagaaaatatagcaataaaaattaataatagtttattcataaaaaatatccttaaataaaaatcaacgcattgtcacaaactcttccgagcctgttgggtgaatggcgactgtgttatcaaaatcagctttggttgcccccattttgattgcaacggcaaaaccttgcatcatttcatcaacaccgaagccaatgccgtgtaagccaacaattttttcttccttgccgacacaaactaatttcattcggcaaggttggcggtgttgtgttacggcactgtacattggggtgaatgaagatttataaactttcacattttccgcaccgtattgctcaaccgcttttggctctgttaaaccaatagtaccaatcggcggatggctgaaaactaccgttggaacaaggttgtaatccaaatgttcatttggcctattgttgaataaacgctctgataaacggcgacctgcggcaacggcaacaggggttaattcaattccgccttcaataatatcgcctacggcatagatgccttcgacgttggtattctggaatttatccaccttcacaaagccacgttcattggttgccacacctgcagcctcaaggttaatcacgtctgttgctggttcacggccaatcgcccataccaagcaatctacgctttgttcttcagcattttccaattttaacgttaaagagccatcagcatttttaacgacttcttgtggaatagcgtgagtatgaagttgaataccatcttggtgcatcacttctaataaagtttccacaataagtggatcgaaagtacgcaaaggagcgtgttggcgaacgaataaatgggtttctgcccctaagctgtttaatactcctgcaagttccaccgcaatgtaaccagcccccacaaccgcaacacgttttggtacatcatttaaggcaaaaacaccatcagaatcaatgccatattccgcccctttaatcgcaggacgacttggacgaccgcccgttgcaattaaaatatgatcagccgtgatttgctctacgccaccgtctgccaaggcaacttcaacggtattcttattcacgaattttgcaaacccacgaataacatcaacattgtttctggctaaaacgttattgtaagaagtatggatacgtccgatataggcttgacggctttcgactaatttacggtaatcaaaacgattgaccgtcacatcaaagccgtaatctggtgcatagcgattgatcgcttcagcaatttgagccccatagaacatcacctttttcgggacacagcctacgtttacgcaagttccgcctaagtgttttgcttcgataatggcacattttttaccataacttgccgctcggttaatggaagcaataccgccgctaccaccgccgatagcgatgtagtcgtaatgtttggtcataaaaggttccttaaaattatctttatttcatatcaatgacacacattaaaaaaacatagccacatccagccataaaagatatggctgatttgactattacttcgcaatacgcttatatttaatacgatgtggttgggttgcttctgcaccaaaggttttctttttccactcttcgtagtctgagaagttaccttcgtagaaggttactttaccttcatcaccgtaatctaaaatgtgggttgcgatacggtctaagaaccagcggtcgtgcgagataaccattgcacagcctgggaactctaagatcgcattttctaacgcccgcaaagtttccacatcaagatcgttggttggttcgtctaataataagacgtttccgcccgcttgtaataatttcgcaaggtgtaaacgaccacgctcaccgcctgacaattcgccaacacgtttttgttgatctacgcctttgaagttaaagcgtccaacataggcacggcttgggatttcaaagttaccgatagttaaaatatcttgtccgtttgacacttcttcccacacggttttcttgtcgtccattgcatcacggaactgatccacagaggcaagtaccacggtttcacccattacgattgaaccgctatccggttgttcttgacctgaaagcatacggaataaggttgatttacctgcaccgttcgccccgatgatccccacaatcgcccctttcggaatgctgaaagataaatcatcaattaaagtgcggtcgccgtaagatttggttagattgctcacttcaatcactttatcccctaagcgtggaccaggtggaataaagagttcgttggtttcgttacgtttttgatattcgcctgagttaagctcttcaaagcgtgccatacgcgccttgcttttcgcctgacgacctttcggattttggcgaacccattccaactctttggcaatggatttttggcgagcattttccgctgcttgctcttgctctaaacgtttctctttttgctctaaccaagaagagtagttaccttcccaaggaataccttcaccacggtcaagctctaagatccaacctgccacgttatctaagaagtaacggtcgtgggtaattgccaccacagtgccttcatagtcgtgtaagaaatgctctaaccacgccacagactcggcatctaagtggttggttggttcgtctaataacaacatatccggtttttcgagcaataaacggcaaagagccacacggcggcgttcgccccctgaaagatgttcgattttagcgtcccaatccggtaaacgtaacgcatctgccgcacgttctaactggttatccaaattgtgaccatcgtgagcttgaataatcgcttctaattgagcttgttcagctgcaagtttgtcgaagtccgcattttcatcggcataagccgcatagacttcatctaaacgagtgagtgcgtttttcacttctgaaaccgcttcttcaatggcttcacgcacggtttgctgtggctctaattttggttcttgcggaagataaccgattttgatccctggttgcggacgagcttccccttcgatctctttatcgatcccagccataatgcgtaacagggtggatttacctgcaccatttaaacctaacaccccaatttttgcccctgggaagaagctcagagagatgtcttttaaaatatgacgcttcggcggaacgacttttccgacacggtgcatcgtgtaaacaaattgcgtggacatatacattccttttctgacaaaaattagggggtattctacttgaaatcagggacaaaatatagctttgcccccgaattgttactgatctttccaatctgcttgaattttcttatgttcataagggaaaaacagttgatcgataatttgccctttacgttcattagaaatctgattaaaccaaaactctgcctgtgataaatttttctctacgcctgcataaccgattatagagtttcattgtttgggctgatgtaacagaagtaaaaaaagaaaaagggcaacaagaatggatttcaacataatgctctcctaaaagagttgctgtaaaagtagatatatcgaaaggcggattgattttataagaaattttacgtttttcctacaaaacaaaagatcaaacccaagctaacatatgccaattacttgggacatagttagttaagtttgatcttcttaaattaccctatattgatgttagaacgagtatcttatattagaattaacagataaatccgtattatattttccaaacacagagccttctaaactcaagcctatacttaacttattattagctctgatattaagccccaagtccatcaacattctggcatcttttttgctattgctagcacttataccatctaccaaaatttcattgcgttttgcaatatcccattgatagccaatgccagcccaagcggtcgctttgctctgtccaatttcaaaagttttacctgcattcacacccaaacgaccaaccagcccatttgaggcttttatggttaatttatgtccgttatcggctaaattagcttggctatttttgacataaatcacttccgcttgtggttcaacatagcctgaacctaagttaaatctataaccaacttcaccacccaaatagaatgaatgggtgtgatattgttgagatttaaaatctaacttcatttctttaaatgcgtagtcaaatttatggttatttttgacatatttagcgatggtatcaagataaaagccgttatcaaataacgctgttgcataaacgcctgcaccgatagattttacatcgccgtttgttgagccgactttcccttcaatgtctgttgaagtatgcgttaccgttaccccagtaaataactctgcatttgaaaggtggctttgtttatcaaaacctgtctgaatatgggtaaatttatgcttatagctatcgctactgcctttaccgcctaatactctagcccatacgcctgcattggcgtcaatgccacgcaactctcccattctcttattgagattgttcatttcaacgtggttaagatcagtatgcaatgaagtaacttcattagcttctttgatcgcagcttgatttggggatttcgtgatatggatatttccattctggccttgtttgaaatcatagattactaatcccttattactaactaacgactgttcagtttttggattaatcaaagttatgtcaacaccatctttttgcacaatataaaatgttacatctcccatattcttagtgataaaacttagttctgggtacgaattaatttcctttgttaaagattctgtcgctttgcttatgataggatcttttgcgttgctttctgaactatcaacaataatctttttagttccttgatcgttaggtagacttgatgtatttggtgtattaattacactaacctcattactactattttcaacatttgccgaagatactgtcgaattattacccatatctaccccattactgttttcgatattttccggtgtatttaccgaatcattattttcggatgctgaacttacagtatcatctgatgccgatgcagcattaatggcttgatttgaatggccactattttcaacttttgttggaagatttgttgagttattgctagtagtagatacattctctacctttgtagtattagttgctgtactattaattgaacaaaaactttctgacacaccaggagccaaacttaacctacaatcctcacgattagatgtatctttataagtaccattatttcttgcctcatctatactgaggtaggtaatactataaatatcataaagatccgttacatacatgcgaccaccgtcaacggcatagctgtaaagaaaacggaatatatcatttcctttattgtcttttgcgtaatttcctaccacctcaaccattttaagatttccagctttatccttaacagaatcactaatccatcctttttttatcttaccatccccatcaacttcaattccccataaggttacggtatggtgctgagaagtgagtgctgcaacaacgtttcctgtcttaaaattatcaattaaagatttagtgactaatttggcatccgagtcataacgttccgtccagaatggaccaccactaatttttgttggacctctctcactttcataatacgtttttttattatgttcttcgtataattttactcctgatgcaaaacgagagaaaaaatactccatacctcgatatggttgtaatccaccctgtatatgcggataagttttatatatccatcctgaaatggctttgctatctttaggagtatcctcgttaaattctacttgcgcttttactctacttttccaccatccgagagtatttcctgcaacagcgccccaacactgatttggatattgtaaatcagcagtccatccactattttgattgactccacttgcccaataagtctgagcttcaactacctgtacagatgaagaaaaaagtgtcgctattacgatcttcgaaagataaggtttcattatgttctcctttaaatcattggatgtgtttttaaattgtattgacgaatcattgtaaatttttttagcgcttaacactttgtaccagcgcaagatatatctaagattccctatattatgtagtatagcttaaaaatattgaatctctttatatttcatatacgttttttatatctttgagacactattttctcgtcaaataatccccttcacacacccatttataggtcgtgagtgcttctagccccataggtccacgggcgtgtagtttttgtgtgctgaccgccacttctgctcctaagccaaattgtgctccatcggtaaaacgagtacttgcgttgatatataccgccgccgcatcgacttgttgaacgaactggcgagccaaagcatagttactggttaaaatcccttcggaatgttggctgccataggtacgaatatgctcaatcgcttgctgaataccatctacaactaccacgctcaaatccaacgacaaccactcttgacgtaattttgcttgttcaagcggttggatttgcggatttttctgcagatcttcagaaaaatcatcgctatgcaatgtcactttcaatttgcaaagatgttcggcgagtttcggtaaaaactgatctgcaatcgccttatcgaccaacaaggtttctagggtgttacaagtacttgggcgttgggttttcgcattggcaatcacatttaacgaacgctctaaatccgcactggcttccacatatagatgacacaccccgataccgccgacaatcactgggatagtcgagttttctttgcagaactgatgtaaacctgctccaccacgcggaataaccatatcaatgaactgatccaacttgagcaattcgagcaataatgcacgatcaggatcggtgacggcttgcacggctaatttcggtaagccagcctgctctaaggcagattgtacgacttcaaccaaaattgcattggtaaatttcgtttctttaccgccacgtaaaatcaccgcattgcctgttttcaaacagagcgaagcaacatcaatggtcacattcggacgagcttcgtaaatagtcaaaattacccctaacggcactcgttggcgttcgattttcaacccactatccaacacaccgccgtcaatcacctgcccgacaggatcggcaaggctcgccacattccgcacatcatttgcaatcccacgaatacgctcaggtgttagcaacaagcggtcgattatcgcctctgaaatcccttgcgacttggcataatcaatatccttcgcattgaccgctaaaatctcatcggtacgctgttccaacgcatcggcaattgcgaacagggcttggttcttttgaacattgccaaactgagctaactcaaagctcgcttgtttggcttgttgtgcaattttaatcattgtcatagttgattctctgtaaaaaataataggggagattttagcatagaatgttggatatatgattatagatagatattaatgctaattctcaataaataatgcttcctgttcatcactaaatcctatacactacgcaaacgtttgcttttttgcaagcggccagatctttagcgattttttacaggggaatttcaatgaatattttgattattggcaacggtggtcgtgaacacgcattggcgtggaaatttcgtcaatcacctttagcggaaaaggtttttgtagcgcctggaaatgcaggaacagcgcttgaagcagggattgaaaatgtggcaatttctgcaacggatctgaccgctttagtcaattttgccaaagaaaatgaggtggggctaaccattgtcggacctgaagcacctttagttatcggcgttgttgatgcattccgtgccgctggattaaaaatttttggtccaactcaagctgcagctcaattagaagggtcaaaagcctttgccaaagactttttagctcgccacaacattccaacagcagaatatcaaacctttaccgaaattgaacctgccttagcctatttacaccaaaaaaatgccccgattgtgattaaagccgatggtttggcggctggtaaaggagtgattgttgcaatgacattggcggaagctgaagaagcagtgaaagatatgctttcaggaaatgcgtttggcgatgctggtagccgtgttgttatcgaagaatttttagctggcgaagaagccagttttatcgtgatggtcgatggtaaaaacgtcgagccaatggcaaccagtcaagatcataaacgagtgggtgaaggcgatacaggcttaaatacaggtggaatgggcgcttattcccctgcccctgtcgtcactccagatgttcatcaacgtgtgatgcaagaaattatttatccgacagtgcgtggtatggcgagtgaaaataatgaatatacaggttttctctatgcaggcttgatgattatgccaaatgggcaacctaaagtgattgaatttaactgccgttttggtgatcctgaaacacaaccaattatgatgcgattggagtcggatcttgttgaactctgtctaaaagcctgtgacggcaagctaaacgagatacaatcaaaatggtgtgaacaagcagcgttagggattgtgctggctgccgaaggttatcctgcagattatcgtcaaaatgatgaaatcacgggaattccgacagattgttgtgccgataaaaaggtcttcctcgcaggtgttagccaacagaatgggaaattagtcacaaaagggggacgtgtactgtgtgccaccgcattaggttctacggtatctgacgcacagcaaaaagccttaaaacttgccgaacagatccagtggcaagggcgtttttaccgccgagatattgggtatcgtgcgatacagagagagcaatgtaaagtagcgtgatgaaataggcggtaggtaatatcgacattttcataaccatatattgagcttactcaaagttttatctgattaaaaagtttacaatcacccatcggtgaaatttaactgatggttttttgtatttctcatcgttaatcaatgagctattataaaagcattcaaatttttcctaccagtataatttcagtattctttccataaatttaaaggagatcataatatgaagccttatttttcgaaggtcttgataactgctctactttcatcctctgttaatgttttggcaaacgatgtctactgggcaagtggagttgataagcaaaaaggttggactgctgattttcaatatcctaaccaatgctggggagctgttgcaggaaatatgcttggttggtggaaaagagaattaaaaactcctgttttatttaatcccaatacaccaaacgataataaggagatttcaaaatggttaaataagaaatatccaaacatacagggaggattatacccatttcgtggaatggaatatttctttgaggattttgctcccactgttaagttatatgaaactcataatacgaaaacttcttatgaggcacagcgtgggccaacaaaaatcagtggtggtccattttggactgagcgttacgactctaatgcagctttagttacaaaatcattggttgaaaacttcaaaactggaaacgttgttgccgcgctaacatcatggacacatactgtgactttatggggcattgaggtagatgaaaaaactggcaaaattaaaaaaggttatatcagtgactctgtagcagatcaggcaggaaaccttaaaatggttgaggtgacaggggattatgtacttgataataaaggtaatgaaatttttcgttttctttatagttactatgttccaaatggaaataaatatgtcaccgatgtgtacgatatttacagcattacttatgtgagtattgatgaaacgcgaaataatggtacttataaagacaccactaaccgagaggattgtaaattaagtttagctccaggagctgatgctagttattgtggcattagtaacagtacaacaacgactactgcaactgaaaataatagttcaaccaatacagagacagtagctgagaatattaacgaagcgagtacagtcacgacagaaccagctccagaagaaacagatgtagatgctcaatcatcaaatacagagacatcggaaacagagactgtaagtgaagtccctccaacagaagaagcagttgcagaaacaagcgagcaaccgaccgctgtgccaactcctgaagttgcagagccagcacctgagcctactccaagcgtagcttcaactgaaacagcgactgtaagcgaggttaaaccaacagaaccagaaaccgcagaacatcgagcggtaaaatcgttaaaagcagctattgctaattatcaagagctaagttttgtaacctcccgtgtcggtgatgtaactcgttatcttattcaaagagaaggtattaatattgctttaattgatccaaatagcaaacagattttggtgaacaatacgggcttagtgaactatgatttaacacaagaccagaatggaaatatccatatcacgaaatcaccaaatcaagctgcgatcaaagaagctaatgaacttacttcattgcatactgatcttaaccacgttgaaatgaacaatctcaataagagaatgggagagttacgtggtattgacgccaatgcaggcgtatgggctagagtattaggcggtaaaggcagtagcgatagctataagcataaatttacccatattcagacaggttttgataaacaaagccacctttcaaatgcagagttatttactggggtaacggtaacgcatacttcaacagacattgaaggaaaaatcggctcaacaaacggcgatgtaaaatctatcggtgcaggcgtttatgcgacagcgttatttgataacggcttttatcttgataccatcgctaaatatgtcaaaaataaccataaatttgactacgcatttaaagaaatgaagttagattttaaatctcaacaatatcacacccattcattctatttgggtggtgaagttggttatagatttaacttaggttcaggctatgttgaaccacaagcggaagtgatttatgtcaaaaatagccaagctaatttagccgataacggacataaattaaccataaaagcctcaaatgggctggttggtcgtttgggtgtgaatgcaggtaaaacttttgaaattggacagagcaaagcgaccgcttgggctggcattggctatcaatgggatattgcaaaacgcaatgaaattttggtagatggtataagtgctagcaatagcaaaaaagatgccagaatgttgatggacttggggcttaatatcagagctaataataagttaagtataggcttgagtttagaaggctctgtgtttggaaaatataatacggatttatctgttaattctaatataagatactcgttctaacatcaatataggggagcctctcccacaatttgtgtaaatacctgtttctgagataatacattcagacacaggtattttattatgaacgaaaaacaacttcacgccttggcagcggaatttgccaaaaatctaaaaacaccggaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcctggaagccatcaatgcagtctatcctaaaacgaagattcagctttgcattgtgcatttagtgcgtaacagcttgaaattcgtttcgtggaaagattacaaagccgtcaccgcagatttaaagcaggtttatcaggccccgacggaagcacaggctcgcgaaaatctgaccgcactttcgcaaaaatggcaggcaaaatacccgcttgtggcgaaaggctgggaagataactgggcaaatattgccacattttttgattatccggctgacattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccattaagttgaaatgggtgtttacacagaatttgggatagggtcatatagggtaatttaagaagatcaaacttaatctagctacgccccaaataattggcgtatgtgagcttgggtttgatcttttgtttttactaaagaggcatttcgaattgaccacagattaagagagaacttaatacaagcaaacaaaaccccaacagaatatgccacaagccattaagctatgctaaacttccccaccttaaggggaaataatatgaaaaatcttatcttcttttttaaactctttatccaccgctttcagcaaaacaaaattgcggtctattcagggtatttgacttataccaccttgctctctctcgtaccattgattatggtggtgttttcggtgtttacgctattaccgatttttgaacaagcgaccgcacagttaaaagagctggtgtacgataactttgccccaagtgcaggggatatggttcagcaatatcttgagatgtttgtcgataactcaaagaaaatggggatcatcagtatcatcggcttagtcgtggtggcggtgatgttgatttcgagcattgataatgcccttaacgaaatttggcataatacgaaaaaacgttcagtgatactctctttcgttgtctatttagctgtgctgatttttgccccgatttttgctggagcgagcattgccatcagctcttatattttctcgttggaaatgtttagccaagacggactgttttcttttagccaccacctgcttaaatttattccttttgtcttaacttggttgctgtttgccttggtttatcttattgtacctaacacccaagtgaagtttagacacgctgcggtgggggctttatttgctggagttttctttacgctgggtaaacaaattttcatctggtatatcaccactttcccatcatatcaggcaatttatggtgcgttagccaccattccgattatgattgtttggatccacctgagctggcaagtggtgttattagggggacaatttgcttccgtattaaaagatatggaaatgatcaaagcaggcgaattagcaaatccattaacggaggacagagaatgatcggattaattcaacgagtaaaatgggcgaaagtggaagtagataaccagactgtcggcgaaatttcaacgggactattagtattattaggtgttgagcaaggtgacgatcaggctaaggcagatcgcttactggaaaaagtcttgaactatcgtatctttgccgatgaacaaggcaaaatgaacctaaacgttcagcaagcagggggaagtttattagtcgtttcccaatttacccttgccgccgatacccaaaaaggtctacgccctagcttctctcgtggggcaaccccagtacttgctcaagcactttacgactattttcatcagcaagcggcactcaaaatccatatccaaacaggacggttcgccgccgatatgcaggtcagcttacagaacgatgggcctgtcaccttttggctacaagtataggcacggcaatgtaccaacagttccagcaacaacttgcaaagcattgccctaatcagaccgctttcttcatcggtttaagcggtggggtggattcggcagtcttactgcatctgttcgcacaggctcgacaagcccttaaccttaaactcagggcaattcatatccatcacggcttaagcccaaatgcagatagctgggcaacattctgtgaacagctttgtgaacagtgggcaatccctttgactgtctgcaaggttcaagtacaaggcaagcaagggctggaagccaatgctcgaacagcacgctatcaagtcattcaacagcatattcaacggaatgaaatgttggcaaccgcacatcatcttgacgatcaagttgaaacctttttccttgccttaaaaagaggaagcggtattcaagggctaggggcaatgcaagcggtcagttttttgcaaaatattgcgattttccgaccgcttctcagcttcaataaaaccgacattctcgcttatgctgaacaacatcaactggaatggattgaagatgaaagcaacttcaacactgattttgaccgcaatttcctacgtcaaacggcgttacctttgctcaatcaacgttggcaacagtttaatcaaatggtggcacgctcaagccagcattgtgccgagcaacaacaactgattgaagaattgctacaccccgaactggctagtcggctacaaaatggcggtttagacatcacaggctttgagcatttttctttgttaaagcaacaacagcttgtccgtttttggctggcacaggctcaccttgcaatgccaagcgtggctcaactggaacagattatccaacatctcattttggcaagagccgataaaaatccgcaggtcaaacttgaacaacaccttattcgccgttaccaacagcagatcttcattacccctattcaagcagagacagatgattttgacttggaactgccaccacaaagtgaagaaattcaactgcccacctctattggcattgttcaacgcaacggcacagagattatttacaaaatatcaggcaaatctcaccgcttgttattgccagaagcgttacaacaaaccccacttcgcctaaccaaccgctatccaagcaaagtgcagtgttacggcaaaacctatcgagaagagatgaaaaagatttggcaggaaaatcgtatccccgtgtggttacggggacgtgtgccaattatcttttataaacaagtattaatagcaattttaaaaatctagtgcattctccacaaaatagttacaaaaataggattgctcgaagaatcatatccaacggccacaacaatccttgaatcttttcccagatcgacaaatacacaattttttcatagcaggcataggaactgttggatcaaaaaaataccaacgatcatctacatttacaaaaagagaacattcatgatgaatttgcacaccatcttctgtattaaagtaagccctaaattcaacaatactatgaattttagtcacattttcttggttagaaataatatcaagacctatccactgagtcttttggctccaatcttttattgcttttaggtcaagcaatgattgctgagcagggagtgtcgttctaactatatagtcaatattaactttggtgtaagcagaataacgagaacgcatcaattcttcggctgtaataggcagtttttgagcaaaatgaaatggtttacagcattcatcatatgctagttttgattggcaaggacaaacataaaacataacaaaatctttaaaaagctctctatctaacttaatatctttatttataggaaaacattatgagtaactgttattactaaaactcatacaccatattaatatacggaattcaataactaacaacggcacactcacccacaacggcaacgtttcaaacttccaaaacgtacccgcaatcgctatgcctaaaatcattaaacgggaaaagcccgtgttattacgttgtgctttcaggctttgattgatttcatttaaacgaaaattaatctgtttttgttgttgcaaggcttgaaacatcgcttcagggaactcggcaaaatgttccctaaattgcggagctcgctgttttagatctcgccacatagccttaaagcccacttgttcattcaaccaatcctgcaaaaacggcttagcggtttgccataaatctaactgcggataaacctgtctgcctaatccttcaatataaagcaatgttttttgcaataacaccaactgtggctgtacttccatattgaatttacgagcaacggtaaacaaattcaataaaacgtgtccaaacgaaatttccgaaaggggtttagcaaaaatcggctcacagacttctcgaaaggcttcctcaaaagcatcaatatcggtatccgacggtgtccaacctgactcaacgtgcatcaacgcaactcggcgataatcacgattgaaaaaagcaacaaaactttcggcaaggtagcgtttatcgttctgatttaaagtgccgacaataccgcaatcaatcccgatatattgtggattttcagggtgatttgggttcacaaaaatgttacctgggtgcatatcggcgtgaaaaaagctatcacggaaaacctgcgtaaaaaacacttgcacaccacgttctgcaagcagtttcatatctgtgccgttggctttgagttcatcaatatttgccacaggaataccataaatccgttccatcacaatcacatttttatggcaaaaatcttgatacatttcaggtacatagagcatttcactgttttcaaaattattacgcaagcggatagcattcgccatttctttgcgaagatcgagttcgtccaacaacgttttttcatactcacgcaccacttccacagggcgtaaacgtctgccttctttatttaaacgtggaatccaactcgccaagcggtacatcaaggctaaatcgtccttaatcacacaatcaatctctgggcgaaggacttttaataccacctctttacctgcaagcggttggttttgattaaattttgccgtatgcacttgagcaatagacgcagaagccaaagcggtttcatcgaaatcatcaaaccacttttccaacttatcgcctagagcctcttcaattaaacgacgagccagttttccgtcaaaagcttcaacagaatcttgtagcaacgcaagctgatctgccaactcaggttcaaacagatctcgacgagtcgaaagcatctgccccagcttaatccatacaggtccaagctcttgcaacgcaaggcgtaaacgcacgccgaaaggctcattcggatattgattttttacccaaaataacgacttccgcccacaacggatcccccgtgttagcggaatatctggaataacctcatcaataccatagcgaagaaaggtatgaataatgtgataaagacgacgcaggtttttgatgttcattatattcccaattttacaaatttttgctctaaccgtaccgcttgttgttccaactcttttacctgatcgcaaaaatcaaccacttgcaaacgatgaacaagcactgggcgttcggtcgtcaagttatcgacaaggtgctgactgtcttgcacaaactgatttttcaccttggtaaaaatacctttggcgaagtccgttgaagcctgagccagtacatcaccgataaaacgtgagagcaattccgcaggatctttttccaactcgtcaagtaactgtgaaaaatgctgtaatacttgaatatcgcctgtcaaaatcagtgttttattattaatcaactcactcagtttacttttatccgccagttttggaagagctgtcgcatcaaggctcaccgcacaatcaacttcaccctcataattcgccagccaatccgcacggttttcactgaaaatcacaaaaagtataatattcggttgatttaactgaattttaagaattttccctgcaagtttgcgtaacatcggcgatgtttggggtgaacgttcaatcaaatgattaaacgctgtttccaatgcccctaacgcaaattgcggtaacatcaactgttgtaataacgttttcatttttaaaatttgtacccacgatgtaatgccacaatcccagcacttaaattgtaataaccgacattttcaaaccctgcattttccatcattccctttaactcgtcttgtttcgggtgcatacgaatagactcggcaaggtagcgataactgtcggcatcattgacaaccacttcgcccactttcggcagaatattaaaggaatagaaattataaacttggctaatcggatcgataatcggcttagaaaattccaacaccagcaaacgtccgcccggtttcaacacacggaacatcgaacgtaacgccttatctttatcagtgacattacgcaaaccgaagctaatcacaatgcaatcaaaggtgttatccgcaaacggcaggcactctgcattcgcttgcacataattcacattgccgacaacgcccaaattccgcaatttttcacgcccgacttccaacattgagctgttaatatcggcaaggacaacttcgccagtttcgccaacaatacgagaaaatttagcggtaaaatcccctgttccccctgctaaatccaacactttctgcccttttcgcaccccactgcaatcaatggtaaaacgcttccacacacggtgaataccaaaagagagcagatcgttcattaaatcatattttcctgcaacactatggaatacattggcgactaactgctgtttttcttctttagcaacggttttaaagccaaaatgggtggtttctgattgtggttgttgagattgttgagcgtcgttcattgtttcgttctcattagaaaaaattaaggcgtaccatagcaaaaaagcggtgagatttccttaattttttgctaaaaaattacgaacttaccatttcgcagtatattaatgttaatccttttctgccttagtagtaatgacattattctatatatttcactttattaatgaaatcaagcaaaaatagcgcaaagaaggatatcgacttaatctcacactctataaataaaaaatctgcactttatgatgttagagactaaacctaacgattaaagtgcagattcaatgatatgatttagtttacaaaaaattaacccataccgtattttttaatttttacgcaatgtaccacggttaataccaagcattgtcgctgcacgagtttggttaccgcgagtatgttgcataaccatatctaacattgggtgttcaatttcagataaaactaactcatataattcagttggatcttgaccatctaaatttcttaagtagttacgaaccgcttgttttacattttcacgaagtggtctatctacttgttgagcttgtgcatttaacattgatactgttaatgggttttgtgtcggttgttgttctaacattgtccttttatccaacttattgagattcttcacgaatcgattttacaaaatcttccaacgcctttaactgttctttcgtcgaatcaagggcattaaaagtacgtctaaaatttgcatttggtttaagctgttcgacataccagccaacgtgtttacgcacaattcgataacctttttcttcaccataaaactgatgtaggttttcaatatgctgtaacattaattggcacttatcattaagtggtaatgtcgaaacgagatctcctttctcgaaaaacttgccgatttccgaaaataaccaagggcgacctaaactgcctcgaccgatcatcacagcatcagcttgtgtatagtcaagaacccgttttgctttttccgcagaggtaatatcaccattggcaataataggaatcgaaaccgcttgtttaactgcctttatgctgtcgtattctgcttcaccttcaaataaacaacttctagtgcgtccgtgaatagttaaagctgagatacccgcttgttcagctatattggcaatttctaggcaatttcggttctcaggatcccaacctgttctaatttttagcgttacaggcacatcaacagcattaacgaccgcatctaaaatacgggcaactaaatcaggttcgcgtaaaagggcagagcctgccatttttttgttcacctttttcgctgggcatcccatattgatgtcaataatttcagctccgtaagcgacattgatttttgctgcttctgccatttcagtgggatcagatcccgcaatctgtacagcattaataccgatttcgtgatgatgcgataaacgcaatttcgatttttcggtatgccatacatcagggtttgtggacatcatttctgagaaagttaaacctgcacctaattggctacacagtcttctaaaaggttgatctgtaatccctgccatcggcgcgaggaaaatacggttttttatttcatattgaccaattcgcatcgacttatccattgattatttttagtacaaatttaacctaaacgatatccaaataaaaagtacggtgtaaaaccgtacttcacaacctttattcagtgttcagcatcattatcgcctactaactcagggacgcgtataatacgcattttttcgccatttgggaagtctatttattcgacaatttaatgaaaatttaaaattaatcaaacaattgttatctataaaagtggtgaacgagatttattcacccattttatcacaacattctcaacgctcgactcaatttgctctcccacacgttgcgataattttttcttttgttgatatttcacttcaatcacgtcttgcgattttaccgcatctaaaatgagatcatcactagtagagagttcatcaacaaggttaaattcaactgcttgttgcccaaaccaatgttcacctgtcgcaattttttctatgtctaactgaggacgatgttgagcaacaaattgtttaaacaagcggtgagtttcctccaattcttgctggaatttctgtttgcctttttcggtattctcgccaacaagtgtcactgttcgcttgtattcacctgctgtcatcacatcaacatcaatatcgtgttttttcaatagacggtgaatattaggtacttgagctaccacaccgacagaaccaattacagcaaaaggggcagatacaatcttgttagcgacacacgccatcatatacccaccacttgcagctactttatctaccgccacagtcaaaggaatggatttgtctttcaaacgttgtaattgagaagccgctaaaccataaccgtgaaccacgccacccggactttctagctttaacaaaacctgatctttctctggttttgccaaagcaagtacagcatcaatttctttgcgtaaagcagatacaccgctcgcctgaatatccccttgaaagttcaagacaaacaaacgggatttctctgcctcagggttttcttccccctcttttaagcgtttcttttctgctttcgctttctctttttctgcttttttctcttgtttttctttatgttttaactcagcttcacttaaaaaggcacttgcaagtgctttttcttgttcttggtatttctcagttaaattagtcagcgtaattgagcctgattctggctgtttacgactttctaaaatcagcattatcacaacagcaacaatgccaaagaccgtcaataattccagcaaaaagataccgtaattaagtaagatttctttccacataatttgttctctcttatgaaatatgtttaattcttcccatctaatccaagcgcttgttagcctagtagcctaattcaatcggtaattcagatctaacccagccctcaaaaccacctttgacactatatacacgctcaaaaccttgctcgacaaggtattgagctgtattacgactactcaccccgtgataacaactcacaatcacaggttcatcataatcatattcatctaaaaacttgccgtagctatggtttgttaagtgaaatgcaccttgaggacggctatgactaaaccttaccatatcacgaatatccactaaaacagcgtcttcattttgcatcatttcccacgcttgttgtggggtaatttctgtaaatgtttcttccatattatttcctctattgaaatcgaggaaatatagcattaaacacaaaattgtaaataaacaataagctattacagcagttgaaatttcaactcacttttatataataggaactattataaatgcgtaattctatacgcatttttttctttatatgataggacttttcaatggatcaactatttcaatttttacaaagctacatcgactatattattcttggtttattaggactaatgagtgtgattttatttgccaaaatcattgaacgagttctattttataagaaagtagaagtcaaagattacgaaacattgcaagagttagaaatcgatctcactgctaacctcacaacgatctcaactatcggctcaaacgccccttatatcgggctacttggtactgttatcggtatcttattaacattctatgaacttgggcattccggtggggatattgacgctgcttctattatggtgcatctctctttagccctcaaagcaactgctgtcggtatcttagtcgccattcctgcaatgatgttttataacggctttggacgtaaagtcgaagaaaacaaattaaaatggcaagcccttgaagctcgcaaagctaaagcataagcggtcacttaccgctaaaaattgacaagcgacgaggatagaatgaaaaaatttgatgaaataaacattatcccattcatcgacattatgttggtgctattagcgattgtattagttactgcctcttttatctcgcaaggtaaaattcaagtaaatgtaccgaaagcctctactacacaagcaatgaaggctgatgaattagcaaaactgctcactattactgaaaataatgaatttttctacaatgataaaccgatcactaaagaagaactaaatgcagaaatatcgacttgggataaaagccaaaaggtgaccttgaaagtagatgcgaccgttgcctttgaaaaatttgttgagctaaccgatcttctggctgcaaatgaaatcaaaaatgtagcaatagtgacgaaaaaagagaacagtaagtaatgaaaaaacgtcactcccgtatcggattaatcggctctctcaccttacacggtacgctatttgcaacggtgtttgggattatccatactcaaaaaccattacctgcaacagaggaagtttccagtatttcaatggaaatgttagcggcacgtttagagcaagaacaagtagcggtggcagcggaagaacctgttgaggaagaagttaagaaacctgagcctgtcatagagcctgagcctattcctgaacctgtaccagagccaccaaagccaaaggaaaaacctaaagaaaaaccgaagccaaaagaaaagccaaaaccaaaagaaaaacctcctgtaaaagccattgagaaaggtgccgaagctaaacaaggtgttgtagcaaaagcaattccgagtgcggtgcaaggtgcaaaaaatcaagagggtattgtaactggctcaccaaaaggtagtggcactgtaaatagtggctcagcaagtggtggggaaattaacgcttataaagctcaattacaacggacgttgcagcaaagagctaacaatgcttatcctcaaagagagaaaatgatgcgaaaaacagggacagtaaccttatcattccagttatcgtcatcagggcaagtaattaatgttcaagtgattaattcgtcaggaaatagcaacttggatgcggcagcaatgaaagcggctcaaagcacaaaaatgcactcgcctcctccagcaggtttccctacatcgctaacggtgccggtgaagttttctgtgcaataatgcttgtctactatacctgctacaactttatgaaaataagagctgtaaagttaagtaactcataaatgataagtttttatccattagtaataggttttaatgtcaactctaatttttgttcaacaatattaaataataagtcaatattcgggtgtttccctggatgttgagttgcatcttcaacatgctcagcaaaccaaataattccttgctgagcagatttaacattcagctgctgactaaatctttctgcaagtgcattatacagttttaatgaacctaatttaccttcaatagcgggaatatggtgaatgatatttccttgtctatccaatatagataagcctgacaaatgttcaatgctagggaaagtcgctaaataatctttaaattgcattttgtttccttttaattacataccaataatgacacattctgctacactacgagcattagataacgccgccattgctttagctctatctccagctggaccaacaacaacgcggttccattcaccattgctattaatacgagcattgtaaccagccatagctaaacgggcctgcatattttctgcttgagctttatttttaaatgcaccacattgtaaaccaaattttccgacattcttaggttgctctaaagcaggctttgctgttgtaatattttttgcctgttcttgtgtttttgggagttgctcttgctttggtttttcttcactaacttcttgttgttgctcttgtttttgttctgttgctgtcgaggtatttgcgactggatcagatgttgctgtttggcttaactgctgctcttctttttgtttctgaattgccaactcttgctctttggttaattgtgccaatttagaatttttatccacaggaacttctctggtttctagatctcgaatgtagctatatacttcttgcggtggggttggcaaggtacttttaggttgctgtgatggtgccatttgtgtcggcattacaggcgtggttggattgctttcttttaaaaaccagagaacaaagccacttcccatcaataataaaataatcactgctaagatcagtgcagtatttccaccttttttggctttagagcgaacagcataatcacgatttggcacaataacctcttttaaatccgatataaaataatctttaatcttactgaaaaaattagattttgactagtaaatcaaatgcccttgtttcacttcaaccacctgatcacaccacttgctcacttcttccacttgatgtgtcaccatcagtaacgtgagctgtttctgttggcataattctacaaccagttgttgcatttccattcgcttttgtggatcaagggcagaaaaaggttcatctaacaacaaaatcggtttatctctaagcagtgttctggctagtgcaacacgctgtttttgtccgccggataataaatccgaacggcgttctaacagttcagcaatgcccatctgctctgcaatttgcgtaatctgttgcatctgtgtagcatcaaaatgcaaacgagaaactagccctaaaccaatattttgagcaaccgttaaatgtggaaaaaggttattatcttggaataacatcgatacaggacgttgagctggttcagtggcaaaatgattttccccattgagtaaaatttccccacgatccgctttttcaaaacctgctattaggttaagcaaggtgcttttgcctgcaccactttcaccaatcaccgcaatgcgttcccctttttttacattgagttgaaactgcattagcatttcagggtaatcaaattcaacatttatataaatcacgtgtgtatctcattaattgtattcaacattgtacatctcggtattgatactgctcactttgattattttggttccaaacaaaataaataacattaacattcctagaatgctttcaggaatacgaatcggtattaatgggctgagcaccttacccaagtaaagtagtaaaaatagtattgtgattgctatgataaagcgtaataatttaattaacatagtttaattcttttattttcttgcaattaatgtatacctacttataggaagtgcatatattaataatacaaaagctcccctaatctggagagcttttatgatttatttccgatatctttcttggtttttacgcattttaatgttgataaattccacaatcaccgagaagcccattgcagtgtaaatcgctgattttggaatgtggatattaaagccttcacccattaatgcgataccgattaagattaagaatgcaagtgctaaattcttaacggttgggttatgatcaacgaaatccccgattggttttgcggcaaacatcattacccccacagcaatcataattgcaatcaccataacaggaatatcatctgccataccaactgcagtgataacagagtctagcgagaatacgatatctaaaacagcgatctggataaggatcataaagtaattcgctttcttacttgtattgccttcagtatcgtgtgcttcgcccttaaccgcttcaatcagttccattgcacttttaacgactaggaataagcccccgaagaataaaatcaggtcacgtcctgaaatcggcttatccataatcgtaaagagcggatcgactaatcgcatcatccacgctaatgaaagcaagagaagaatacgagttgccatcgctaaacccaagccgataatacgcgctgactgacgttgtttttcaggtaaatgagaaactaaaatactgattaaaataatgttatcaatacctagcacgatttctaacgccgctaaggtaaagagagcaacccacgcttctgggctggcaatccactcaaacatagaaagatccttgataaaattagacataacatcggcaaaaattgccgaactaaaagttgcacatcatatagagagctgtggcaaaattaaaggggcgaatgcaaaaaattttgtaaaatctctgcggtaaatggtttacgcaaataaaaccctagtggtagtgattgaattttttcaccatattgatttacagcccctgctaacgccttattatttcgcccttttggacgcaaatgaagcacttcccctaaactcgcattgatctcatttaaacgtccaagcacaatcagttccattaactcttcccagtcttgttgtaactgctgttcttgttgttgggacggcgaccataaaatcggctgtccgatatgccttttttcaaggggaattgaccgcttaccttcgactgggatccacaaaacccgttgcaatttatgtttaacatgtgacgtttgccatacaataccgtgattatccgttaaaggcgcaaggctgacaaaggtagtttctaacggcaatcctttttcattgacaggaatggttttcaactcaatgcctaaatgggcaaaatcttgttcaggcttactgccagcctttgcccctaacgccgtttcaataagcatacccacccaacctttatctcgacgtaaatcaggcggtacaaccatattcaacagttcggcaatttcccctagggtaaagcctgcgagccattgagctttggcgagaagctctgtttctgtggtggaatgggtggcaagttgcattgaagtgcgatctcttatgcgaaaataagcggtcacttgatcataaaaatttgcaaattttttatctgaaccgaccgctagttattcaaatataatgcttttcattttaccatattttactaacaatattttcattgagaactcttagtatttaagttgaaataaagtttgtaaaaaattaggggctgtcctagataacgactaaaagctctattttaagttaaaataaccaaatgagaaaaagtcgtctaagtcagcataaacaaaataaactcattgagctgtttgtggcaggcgtcactgctcgaacagagcggttgagttggtaaatataaataaaacgacagcagcctattacttctatcgtctgcgattgcttatctatcaaaacagcccacatatggagatgtttgaaggtgaaattgaagccgatgaaagctattttggcggcactcgcaaaggtaaacgaggtcgtggagctgtgggtaaaaccgctgtattcgggcttttaaagcgtgatggtaaggtatatactgtcgttgtaccgaatactcaatctgcgacacttttaccgattgtgagtgagtttaatcattttcgtatcaatcacagtaacttaaaatcttaaatttccattttaaaacaattagttaatggcagcttaagttagttatctaggacagccccaaaatttatgaggagacaaatatgaacaaaataaaaaaacttagtattacattacttgctagttgcatcttagtagcttgtggtggcggtggttcaagtggtggtcatcagcaagctgtagataaaacaggaaatcctattactaatcaacaagtaagtgaaaataacccccaatctttggataaaaataatgctagcaaagctcccgaagcaaaagaggataagcaaataaaagagccaattgttggtaagcaatctaaggaaaaaatagagcctccctctcaacaattgagtgatcaagatatttggcacggcttctcgaaagatggtggttattacgatgcgaacaattgggtgagtattacccttgaaggcaaagaaatcaagctagccccagtcaatggtagcaattcaaataatagtaaaatgaatacgttacgagatgccgatggaaatttggttggatattatggttatgcgacattaagtaaaacaaaaccagatccatataggcctgatgagaacaatgttgaacgcaaatatatggctttacaagaagtgaccgcaagagaagaagccaaaactcgtccaactcacgatttatcttatcaaggaaaaatgtactatgctctcaacgatgctcctgaacaagctaaagaggctgatgttacagcaacctataaacatatgaataaatcaatttcaattaatatttatggtgtgaatggaaacgatttaactactaatcaaacaaatgttagtgaaaatggttatattttcactcgtttatatttgatgggtaaaccaagaacccccgcagggcaatttgatggtggtttatatggcaaaagtggcgagattttattaggaaaagcgaaaaatgaagatgcaacaccacatacccctcaaaagaattgggaaggagttattggtgcaactgctatcaaagacaaataatagtttctattgttaaaaaaatgcctttgttttctttaacaaaggcatttttgtattccactgaattaaccctgttctgccaaatctaacatttcctgagcattcgctaacacagcatcggtaattttttcccctcctaacaatcgggctaaggcttttactcgttcttttggtgtcagcaagctcattttggtttctgtttggttattttcaacttgtttttgcacgttaaaatgatgattaccgtgacttgccacttgcggtaaatgggtcacgcatagcacttggcattttttacccaactggcgtaataatctgccgaccaccgttgccgttggtccgctgatcccaacatcgacttcatcgaaaataatcgttggcgttgaaagtttattcgccgttaaaacttgcaccgcaagggaaatccgtgatagctcacctccagaggcaattttggctaatggttgggcattttgccctaagttactgcgaagattaaattcaacgaaatctgcgccattggctgataatttgtcgagattatattgaatatcaatgaaaaattcgccgttttccattgctaattgtttgatctgtttggtcacttcggctgacagtttttgcccagcatctaccctcttgtgataaattttttctgctaattcaacacattgttgataggcttgttgctcgtctgcaattaactgttcttcattttccgcaaaatctaatagggtttgtagctcttgttttaagctcagatgtttttgccataacttatcaggggtaatgtgatgtttgcgagccagttgcattgtttggctaatgcgttgatctaattcatttaatagctcaggatcttgctcaattttattggcaagatgattgatttcggaactggcttcctgtacctgaattaaggcttcattgagcatttctaatgccgattgatattggctatcgacttcgactagctcttctaaatcccgaatagcacgatagagcattgtatctacattggcattatcatcacttaacaaattcaatacagattgtgacagttccgttaattgctcagaattagcaaggcgagcgtgatcttcttctagttgctcaaattccccttctttaatcgcaaattcatcgagttcttccacttgatattgcaaaagctgtttgcgtgcttcattctcttggcattgttgatggaaatttttcacctgcttatgcaattttcgccaactatgatattgcgttgccatttccgctaataatgggtgtaaattggcataattatccaccacttcaagctgatactcacttttcagcaagagttgtggagcgtgctgaccattcaaatgaataaggtattgcccaagctctcgcagttgcgaaactgggattgggtgattattgacaaaggctttggaacgcccttcttggttaatcatacggcgtaaaatgcactcttgtggattatcttcatcgagtagctcgtgttcctttaaccataaatacgcagggctagtaggttgcatagaaaatgtcgccgaaatatccgctttatctgcaccattacggatcatcgaactttcagaacgatagcctaagcataagccaagcgcatcaatcccgatagacttaccagcccccgtttcccctgtaatgacggacattccttcatttaattcaagggttaggtgacgaacaattgcaaaattattgatggttaattgagttagcataagaaaatacccatacgaaacactgtatgagtatatagtatcactgtttttatacacagtaaataaaatacagaaaattttatggtaaagaataggacaaatttattgttattttggaagatatattcagatgcaatgtacattacaaggaatacatccgaaattagcccaagtaatagggctaatttcagattgttgacaaagatatctatactatttccatagcttaagataaatattaactacaccaactccgccctcaatttcttggttacttccaccatcacttgcaactgctcaatggtttctttccagccacgggtttttaagccgcagtctgggtttacccataagcgttctttcggcaccactttcaaggctttacgcagcaggtgttcgatctcttccgctttgggtacgcgtgggctgtggatgtcgtatacgcccggtccgatgtcgttcgggtatttgaaatcggcaaaggcggtgagtaattccatatcggagcgtgaggtttcgatggtaatcacgtccgcatctaagccggcaatcgcgggtaaaatgtcgttgaactcggaataacacatatgggtgtggatttgggtgtcatcttgcacgcccatatagcttaaacggaaggcttcacccgcccattgcaaataagcatcccaatctgaccgcttgagtggtaagccttcacggattgctggttcatcaatttggatcactttgatccctgccgcttctaaatccaacacttcgtccgacaatgccacgccgatctgtttgcagaccgttgagcgtggaatatcgttacgcacgaacgaccattgtaaaatcgtcacaggtcctgtcagcattcctttcatcactttgttggtgaggctttgagcatattgcgaccaacgcaccgtcatcggttcaggacgagctacatcgccataaatcacaggcggtttgacacagcgtgagccgtaactttgcacccagccgaatttggtaaaggcaaagccgtcaagcaattcgccgaaatattccaccatatcattacgttccgcttcgccgtgaaccagcacatctaagtctaactcttcttggcggcgaaccacatattcaatctcttttttcatcgccgtttcgtaatccgcaaggcttaaatcgcctttcttaaagctcgcacgagcgtggcggatttcgctggtttgtgggaatgaaccgatatttgtcgttggtaaaagcggtaagtttagccacgcattttgcttcgcaatacgttctgcaaatggcgattgacggcgatccgccccttcaggtaagttggctaaacgagccgctacttctgcacggtggatctcttttgatgtcgctcgggcattagctgccgtttggcttgccgctaattgtgcttgtaccgctgctcgaccttgttcaagtgcggtcttaattaccgacaattcttcaactttttgtagcgtaaaagcaagccattgataaagttcaggtttatttgcttgtaattgcgtttccaccgctaaatcaaaaggtgtatgtaacaaagaacagcttggggcaatccataaacgctcgccaagtttggcttttaatggctcaagcacgtccagcacttgatttaagttcgcacgccaaatgttacgcccatcaatcacgcctgccgaaagcactttgctgtaatcttcaaaggcagcaagctgttcaggcgaacggattaaatctaagtgcaagccatcaaccgctaagcctttgagcaactctgcgtgttctgccactgagccaaaataggtggctaataacaatttcgcatccacttggcttaattccgcatagaccgcttgataagccgccagccattgtgccggtaaatctaaggctaaagcaggctcgtcaatttgaatccattccacgccttccgccgcaagtgcggttaaaatttcacggtaaacaggaacaagtttgtttaataactcaaaacgattaaaggcttcgcccttctctttgcctaaccaaaggaaagttaaaggcccgacaatcacaggtttaaccttcaagcctaaggctttcgcttcacggatttgattaacgtagtgagcagggttggctttaaattcggtatttttgtggaactcaggcacgagatagtggtagttggtatcaaaccatttggtcatctcaatggcaaattgatctttgttaccgcgcgccagttggaagtattgcgaaagggttaaattttggctgtcaaacccaaaacgagcaggaattgcccctgttgccacttgcagatctaaaatatgatcgtaaaaggtgaaatcgcccacagccacgaaatcggcattcgcagctgcttggtgctgccagtttttttcacgcaaggctttggctaaatctaataaatcttgctcggtaatttccccacgccagtaacgttcctgtgcaaattttaattcacgtttcgccccaacgcgtggaaagcctaagatgtggtatgttgtcataatgttctccttcaatagatttgatatttcttttatttagacgtttagccgtctaaatggctagttgtataatctacaaaataacaacattatgcaagttcataattttcacaaacattatgaaaatttttcatgttgacttatacacccaagctcgaaaatcattcaatataccttatgggtatagatggaatagatagagattttttctctaaagatttattagcatttcttcaaaatccacttcaactctcaacgcctctaacatcgctttccccctcggcagcacttcaacctccgccaataacgccaccgcttcgctcaaactgctagcggttggataagtcgcattttttgcaaaaaattcggcacaatcgaccgcttgttgattgaatagactaaacagcagttgttgcagattttgttcgcgtaaacaagttgggactttttgaatggtaaggcgagtttgcccttgccactgttttgtttgaatatcaaaacccaagtctgccaaagcggtttgcgattgttgccaagacgctgtttgctgttcatcaagggttaaactcaatgggatcaacagagcttgattttcccttttggctaactcagcttgtagttttaattgagccaatttttcaagggaaagcagataaaaggtttcgccctgtttcatcaacaaggctttctgtttcactaccgctaaggcttgggcatagggcgtggccggctcggctatcggttcaacaagcggtgtgatcttggcggtttttggcaaatcttgaacgggttctgaccgcttatagtcttgcataggcgatgtggaaagcaattcgccataccacttctgttcgtttttacttacccctgatgagcgagtgttgctgtaactctggcgttctgcgtgagttgatgaagttgagcgtggttcacgatagctgtgtgcaaaaatattctgccccgaagctacacggttggtgtcggcaatataattcggcaatgcttcactgacattcgttgtcagcggtaaatgatgttgatcttcaagggcattcaaaacaccttggtagatgaaatcgtggactaagcgactttgatgaaaacgcacttcgtgttttgcagggtgaacattgacatcaacgtggctcggatcaagatctaaaaatagcacaaagacagggtaatgatccttcggcaaccgttccccataggcttggcgaatagcgtggttgatcgttttatctcgcatcattcgcccattgacgtagctgtaacagagatcgttttgcactctcgctaaacttggtgagccgacccagccgtaaatatgtagatcgtcgtgttgccaatcaatgtgtaccgactgctgaataaactcatcaccgcaaatcgttgcaacccgtttttgttgctgttcaagctgttgtgtcgccaccgctttgtagtaacgcacttttttctcattatgggtcagcgtaaaagtcacattcggttttgctaatgcaatacggcgaaccacttcatcaatatgggcaaattcggttttatcggtacgcaaaaatttacggcgagcaggggtattgaagaacaagttagccacttcaatagtcgtgccgacagggtgagaagcaggcttgatttcaacctccatttcacgcccttgtgcataggcttgccacgcttctgcctgatattcggggcgagaagtgagcgttaaacgggacaccgagctgatactggctaaggcttcaccacgaaagcccagacttaaaatgctctccagatcttcaagagtagcaattttgctggtggcgtgacgagccaaagccaaagcgagatcttgcttgccgatcccacagccgttatctcgaatacggatcaactgcgatccacctttctcaatatcgatctgaatttgcgttgcccctgcgtccaagctgttttccaccagctctttaaccaccgacgcaggacgttccaccacttcgcctgcggcaatttggttggcgagttggggagggaggatttgaataaggggtttagatcctttaacgctcatatgtaagaaaaatagagataatttgaaatagattctatcacaaataatatttattacgttgagtatcaaataaattctcttattctatttctatgcttattagaattagcttttacacattaaattttatgagatttgatacgatgcttactattctcaaatagataagctgtaggaaagcatttttatgcaaatcaaaaaaaccgaccaagcggtcggttttccaaaaaatttgcaaatttgtttaaaaagcaattacgctaattttttgatttgagcagctaacttagatttgtggttagctgctttgttagcgtggattaagcctttagatgccatacgatccacaactttttgcatttcaacgaaagccgcttctgaagctgctttatcaccagttgctactgctgcgtatacttttttgatgaaggtacgcatcattgaacgttggcttgcgttatgttggcggcgtttttctgattgaaccgcacgtttttgtgctgacttgatattagccaaggtcaaactcctaaaaatatctgtgtaaaaataaaaacataaaaaacaattttttatgcagtgctatcgatagtttaaattcattttcaacgagacacgggcttgaaaataacatcgtttcacacaagaaatgttcttgagtaaaagatagaggcggattctagcagtttttttctgattttcctataacaaactgctaaaattccgatcaattttttaagaagataaagagaacaaattgtgagcaagaaattattaagatcaggaatgattgttagcggtatgaccctactttctcgtattcttggtttagtgcgtgatgtggtggttgccaacttactgggtgcaggcgttgccgccgatgtatttttattcgccaaccgcattcctaactttcttcgccgtttatttgccgaaggggctttttctaaagcctttgtgcctgttttagcggaatataatgccgataatgatccagacaaaacccgtgagtttatcgccaaagtatcgggaacgttggggggattagtcactgttgtcaccttagtcgcaatgcttgcttcccctgtgattgctgcattatttggtacgggctggtttttagattggctcaatgatggacctgatgcagaaaaatttacccaagcctcgttgttactcaaaattacatttccttatttgtggtttatcacttttgttgcattatcgggggcgattttaaattcgttaggtaaatttggtgtaatggcgttttcccctgttctgttaaatgtggcaattatttgcgttgcaatttggggaaaagatttctttgcctcgcccgatacggcacttgcctggggggtatttttaggtggcttatcacaattcctattccaaatcccttttatgaaaaaggaaggtttattggttaaacctaaatgggcttggcatgatgaaggggtaaagaaagttcgcaacttaatgattcctgccttattcggtgtatctgttacccaactgaacttgctcattaatcagattattgcctcatttttaatcacaggctcaatcagttggctctactatgctgaccgtttaattgagttcccacttggattattcggtattgctatctctacggtgatcttgcctagcttatctcgtattgccaaacagaaagatttgacggaagaacaacgtaaatttaactttgagcaaacaatggactggggtgttcgtatggtattactgtttggtattcctgcgatgattggaatgatgatccttgctcaaccgttgataatgacgatgtttatgcacgggaaatttcaactcaatgatgttatcgcttcttcgcaagctctgtttgtgatgtgctttggcttaattagctatatgttaattagtattttggcgaacggcttttatgctaaccaaaacaccaaaacaccagtcaaaatcggtatgattgcagcggtaagtaatatctgttttggtgtactggctattcctttcggttttattggactagcaatggcttcggcactttccgctgcggtaaatgctggcttactttatcgtggcttatctcaaaagggcatttataaagtcacaacaaccacggcaatttttacccttaaactgctgattgctgcctgtgtaatgggggcgttagtgtcctatttttctccggatttaacaggttggaacacattgaatttttgggcgaaagtccattggcttgcgtggttaattgtacttgctgcaatcagctattttgccactcttggggtgcttggtgtgcaaataagatcattcaaggtaaattaaagtgactatttttagatcgtatagcaatatgagaatatacattgctacacgatattttgtacattaactttcaatcccctcaaacaacaaggtacttaaataacgttctgaggcggaaggtaaaatggccacaattgtcttatccgcaaattcaggtaattttgctaaacgatctgcgacagcgacagctgcaccagatgaaatcccgaccaaaataccttcttcggctaacaaacgacgagcggttgcaatggcggtttcgctatccacttgctcaacacgatcaatcaaacttaaatccaagtttttcggaataaagcctgcaccaatgccttgaattttgtgtggacctggtttgatttcttctccgtttaacgtttgtgtaatcactggcgactcggctggctcaaccgctacgctgatgatttgtttacctttatcttgcttgatataacggcttactcccgtgatcgtaccgcccgtaccaacacctgcgacaaaggcatcaatattgccttctgttgcttcccaaatttcaggacctgtcgtctgctggtgaatggctgggtttgctgggttttcaaactgtttaagcataatatagcggttcggatcactcgcaataatttcttcagctttggcaattgcccctttcattccttttgccccttcggttagcaccaaatttgcccctaagccacgcagcaatcgacgacgctcaatactcattgtttcaggcattgttaatgtcaatttataaccacgagccgccgctacataggctagcgcaatgccagtgttaccactggtggcatcgacaatttccttatctttcgtcaagataccatctttctctgcctgccataccatatttgcaccaattcggcatttaacactaaaacttggatttcgggcttctactttaaccaataaattcccgttgtgaccaaaattctttaaacgaacaatcggggtatttcctatcgtttgtgagttgtctgcataaattgtcattgttatgttcctcgtgctagtttgaatgtggttagcatacggatttttagcctaatgttaaggataagaatggcatttaatataactaaaagaaataacaagcggagattttctcagggaattttgcaaccactgacgcaaatggtatagtaaccctttatttctaacgcttagattgaccaatgaaaaaacagcaatctactcaaaaacgaacgcttactcagcttatttcccttgtggtgatcagtattttttccgtcattacttggtttaacaatgaaaagaaagaacaagaacgtaagcaaccaacgccagcaccaacggtttcacaaagcaccaacaatgttgaaatcccaagccagttaggcaattacgataccaatatggcaaaagataagtttgggcaaaaccgccaagcctctgtggattactatatgttagcactttcgtggtcgccaagtttttgcgaagaacagagaagcaaaaataacggaaacgttccagctcatcttgcattgcaatgcaaccaagcctcgaaatttggttgggttattcacggtttatggccacaatcggcaacggcaagatcagctgatgaacacccacgtttctgccaaggcgatttggctcaactacctgaaaatctgattaaacaatatctaccagagtccccaggggcaagtttgttacaaggacaatgggaaaaacacggagcctgtgcgttcaataatgcaaaagactattttgagaaacagaaacaacttttccgtagcctcaacctaccagggcaagaactctcacgcaaagagctatttgcgtggttaaaaaaatttaacccacagcttaaagaggcttatcttggagccagtcgcaacgaactttatatttgttacgacaagagctggaacgtaatggattgtcctcgctagtgcaacatcttcgtgaactcaaaatgcaagtccaacgccagttaaaacgagatttggacaaagcgaaccgctattttaacaaacactttacgcccccaacggtaagttacaccgtacgggggcgaaaagctggcgtggcttacttgcaacaaaatgaaattcgcttaaaccctattttattgagtgaaaatagctcaaacttcgtgcaacaagttgtcccacacgaacttgctcacctgctggtttatcaacaattcggacaagtacagccacacggcaaagagtggaaaatgatgatgaaagacgttctcggcgtacctgccgaaacgtaccattgctttgatgtcgccaatgttgtaggacaacaattcccctaccgttgcggttgccaaacgcactttttatcaatccgccgtcacaacgctattatgcaacacaagcggtcttatatttgcaaaaaatgcaaagaggtgttggtgttgaaggtcaagtgaacattgctacttaagaaaacgttccatctgaatcataaatgtcgacttttaggtatagtagacaaattttttctgaactgttttgtctactatacctaatatctcagggcaatcaatatagctacaaagtattttttaaagcctctcgaataagttgctcacttgttgattcagatttcttgtttacttttttaaccattttttcagcatctgctgccttatatcctaatgaaatcaaagcatcaatcgcttcatttactgggctcatagacgccattgataaaagatttcctgatggttgtaaaatagaaatttcatgatgaaataaagttgaaaattttcctttcaattcaaccaacaaacgctctgccgttttacgtccaatccctggtattttgataagttttgctaattcttcctgttctatagcagacataaattcagaaactgacattgctgacaaaatagctaatgctaacttaggtcctacaccgtttgttctaattagttcacgaaatagcatacgctcttgcttctgaacaaatccaaataaaaggtgcgcatcttctcggattaccagatgagtgaaaatcatggtatcttcattaagatcaggtagattatagaaactagtcattggcatcaatacttcataacccactccttgaacatcaagtaccattgatggaggagatttttcaataatcctaccacaaagtcttccaatcatttttgtttatccattaagtaatagggcaattagaataatagaaaataagatcacagtattttattttttaatacacaaataaaataaatttcccgatagataaccattctgaaaggaaaactgagatcaaaaaggctgtgttccgtactcctgaacacaccctaaaccacagattctctaatttaccgcaaaattatttcggtgcaccaattggtaacactgtacgtccaaaactttcattaagaatttcagcagcggctaaatagaatgctaataatgcagttaataagccgaagttaccaccaatgtgagtaatagttgcattgtgagtgaaatcacctgctgctaataggtagaatgtgatggtaagcgcaaggaaaatcgcttgtaacgcacgcggttttgttaaggtgccgaagaacacttttaataatgcaaatgaccaccagaatgcaccatagctgataaatgcagtgaaaccaaaagtgttaccttttgagtattcaaacatacctgcaatcatttgtgcagtaccgccgaaagcgaagcccattgcaagcactaagcctacgttttcgccaccgaaagtaccgttgttgattaaacttaatagccacgttgttaatgcgaaaccacataaaccaagtggaccaggatttgctgttgctgtattgtgagcagacattttttaacctctaattaacgctttgttctaagtaaattccagtatttttcataagtttcaacggcatcgccgacatcactttgtaaaacacctttttcaatttctgcaagcggtgggaaaatcagtggatcttgcactgtttctgcaggtaataatgccttcacattttcgttaggcattgagaaacccattatttcaatcactgtttttgcactttcaggacgcaacaagaaatcaataaatttatgtgctgcttccttattttttgcatttttaggaatgacgtaattatccatccaaattaccgccccttcttttgggaagataaattttaagtctggattttcactcttcgctctatatgccgaacctgtccattgcattccaatcgcaacttcgccttgtaaatagggcatttcaggagaatccgagttaaatacaagtacatttggcacaagttttgttaaacgctcgtaagcggttttaatttcatcagcattggtggtattcggtgatttaccgtctaacaataatgccatatgaaacacttcacgagagtcattcatcagcaataccttgcctttgaattctggtttccataagtcgccccagcttgtaatcgtgctcggatcaatgtctgatgcattcacaccaatacccgttaagccatagacataaggaagtgagtatttgttttcagggtcaaactctttacccattaaggctttgcttacgttgtggaaattgctcaatttgcttttatcaatttcggctaacattccgtcttttgccattttcccaacataatagcttgacgggaaaacaatgtcgtaacctgacccattcgttaattttaactttgagtacatttcttcgttactttcaaaggtggagtagatcacctcaattcccgtttctttggtaaattgttcgagtaaagaagatggaacatattctgtccagttatacacatacaatttttcggctgcctgtgcagtaagtgcaagaaatgcaacgcctgcgacagcaagtttattcaaaaatgattgagcaaatttaaccaatcttcaaatcctcttaatgaaaaagataaatgatttctttgcaaagatcggcagctaaacgaccgcttgtttgcaaattcctcttgctgaaaagcggtgaagtatagcgattttgtggcgatttttctatcaaaagttatcaaaaggaataaaaaaagcgacccgaagatcgcttttctagcaagagattacgcctcacaactactacaacttaacaagttacggttaaacacttgtgccgcactcattgagtattggtagtaaattgatttcaagcccaattcttctgccgttaagtaaagttggtttaaatcacgagcaggggtagcagggtgaaccataatgttaatactttgcccttggtcaatgtatttttgacgctgtgccgcttgctgaataacgcttaactgactgatttcagagaaagttttaaagacctctttttcgtgttcagagagctgtgttaaatgctgaacagagccatcgttcaataagatactttcccaaatttcttcggtatctaaccctttttctctgagaagttgctctaagaatgggtttttataaaccgttttaatcttcgctaagtctttaacatagtagtttgatttaaacggttcaaccgacggcgacacactacctaaaataaagctacttgattttgtcggagcaatactcattaaggtggtattacgacgaccatagccttttaacaattcaggttcaccaaagcgttgagcaagttcttctgaagccttcattgtcttttctttcaacgttttaaagatgatgttgtttttctgcattgcctcaaaactatcaaaaggaatattattggcttgtaaataactatgccagcctaacacaccaattcctaatgcacggtgacgtttagcaaaacgatttgcacggtcaaggaatggaatttcagcacttttctcaataaattccgacattactacatctaagaagtaggttaatacttcaggagcatcagtatctttccactcatcaaaataaagcaagttcattgaagataagcaacaaacgaaactctcttcattatttgacggtaacataatttcggtacacaaattcgaggcgtgaaccgtcatatttttatctttatacacatcaggacgacctgcatttgcattgtctttgaagaacagatatggaatgcccgtttctgttttacgttgcaaaattttcgcccaaagttgtcgcttgtatggatcacctgctttcattgactcaagccagtcgtgtccaacacatacgccatagtacattaactgaattggattaccttcggtatgaatatccaaccactcatcaatgtcgccgtgttcaatatcaatgtagcctgcgaattgtcctttacgagaagtaccttgtgaaataacatcgatcaccgtatcaaacaacttactaaagttaaatgaaccgtctgattttccgttatttttaatcaaactaccacgcggacgaatatcaccaaaataggctgacgtaccgccaccgattttactcatcatacccacttcagcggttgtcaccataatttcgtggatcgaatcgccaatatagctaccaaagcatgaaatcggcaagccacgatctaaaccgaagtttgaccaaatcggcgaagagagcgagaaatagccacgtcccatatagtagtagaacttgtctgcatagccttcaatacctagcttacgctctgcgtgttctgcaataaaacgaatacgatctaaagcagttgttccttccaacaaatagccacgttgcaagaaaagacggctatcgtcattcaaccactcaaaatcaggacggtttacgttagtgtagccaagttggaataactttggctgataataatcattagaataagtcatcggcagtaatctgtttcatttttttactataatcggtactacgtttgttaaagaaatctgtttctttagttgaaataatttcaatatcaaaccactctgtttcttttaacaactcaggatctacatcgtatggtggttctaaccccaaaatagataatgaattgttatagcgattcataatatagttttcgacggttttacgagaaataaaacttaaatcaccctcttcaaaaatccagtctaaaatgcctctctcagcttcaaaggcttgttgagataaagttttgagttcttcaaaaaactcaggggtaaataattcactatgctcatcactcaaaatttcatataacgcaataccaaaacgcccgtgaatttcttcttcttttgaagtcgcttccaccgcattagaaatccctttaaacagatttttatgcttattgaaagacatcataataatgaactgaccaaacaacgaaatatgctcaacgaacaacgagaacaacacaagagatagcacaaactgccctttgcctgtatccttctcacgcataaaatcttccatataacgaatacgtttcatcaacggctcaatttccgtgatttgcgtaaacatatcgtttaagcctaatttttctaacaagaaagagtaagcatctttatggcgaacctcactttccgcaaaagttccccccacatcgtccatctctggttttgggaaataatgatatagctcaccccagaaacgtttaacgttcacttccacctgtgaaattgccaacattgcacgggttaaaacgtggcgttcgtggtcattaatattagtacggtaatcttgaatatcccccgtaaaattaaattcggtatgcaaccagtacgagtgacgaattgcatctttaaactcaagtaattcggggtattcataaggtttgatttgaatgcgtttttcaaaaatgttgcgtgccataatgatttgagcttcgtggttgattattcaatggggagtattttagagatattttttcgttctacaagatcttgacaaatggctatccctgattgtgtcgtcctagtgattgattttaaaaggaaaaattttttgtaaaaattcagtttcgctcaaaaactatatcttgtgtttttaaaaattagaaacacaagatatagtggttgcaagtggttggatttggttattttttacaaaaacttgatatgatgaactattgcataatattcattttgtaggagctgagttccctcagcccttatccaattatcttaaaattaatccatctcactcatcaaactcgcatttccaccagcggcagcggtattaatgctgatagctttttcgtgtagtaatgggaataatgaaagggcaaggtcaagattttccacataggtgagaattgcccctgtgcgttctgcatagtgagctttttcttctaatgaaagcggttcaagcacaatcaagctacttaaatttgctaagctattgaaatcattgctaataatcactaagcctgcaaaatgctgagcctgtttagccagtggcgaattagaatgtaccacagcacggctacccgacaccactacggcaatcaaggcttgaatttgttgctctagtgagccattaccgattgcaataactgggcgagcttcaaattgcataaagtttacttcccctgtaatcccttgcattttaaagactttctctaacggcgactggcgagaaagacttgcaataagatcttgggcattttgtaattctgtgcctgaaagcaccgcttgtatgcctgtgagtaagcctgaagtgtcggctggtttgcccccttctaaacccgataatgtccattcacagcgattaactaagcgttgtaggtaaagtggcccaccggcttttggccctgtgccagataatcccattccgccaaatggctgaaccccgacgactgcccctacggtatttcgattaacatagagattgcctgcgtaaatactttcaagccataaatccacggtttcatcaatacggctatgtaagccactggttaagccaaagcctgtcgagttaatgtctgccatcacttgcggtagattatctgcatcaaatcggataacgtgtagcacagggccaaatacctcgtgttttaattgattgatatgctcaatttcgagtagcgtcggcggtacaaaaatgccagtttgagacagttcaggatcaatcggaacttgatagcacgatttcgccacttttttcatttcgtcgatatggttgagcaaacgttcttgagctaccttatcaatcactggaccaacgtccgtattaagattttgcggtctgccgacttttaactctgccattgcccctttgagcattgtgaggatatgctctgcgacatcacgttgcaaataaagcactcgcaatgcagaacaacgttgtcctgccgaatcaaaggctgagtttaaaacatcagcaaccacttgttcagctaacgcagaactatcgacaatcatcgcattttgtccgcctgtttcagcgataagcggtacgatatgggctgatttttgcaaattgcgattgatattcttagccgtatccgttgaacctgtaaaaatcacgccatttactcgtggatcgctcactaaggcagagccgatcacttttccgctaccggttaaacattgtaaggcttgctcagggatacctgcttgatgaaataaactcacggcataatatgccattaaggaggtttgctctgcaggtttagctaataccacattaccagccactaaggccgaggagacttcgcccacaaaaattgcaagcgggaagttccacggactaatagcaacaacaattcctctcggattgcgataaccttcagggttttgacgaacttcttttgcataataacggcaaaaatcgaccgcttctcgcacttcggcaatcgcattatttaaggttttgccagcttctcgtacggctaaatcaaagagctgaggcatatttgcttccatcaaatctgccattttttcaagtgcttcggctcgaactataggggacgtgttttgccactcagctttaaactgttccgcaactgcaaaggcttttgccacatcattttctgttgcctcaatcacctcaccgaccacttctgcgatatttgcagggttgtgaacttggcgagaatgaagattttcagttttttcgcctgcaatttgtggctcggcacgatattgtcggcttgcaagttgatttaattccgcttctaatgtttttaagtggatcgcatcggttaaatcatagcctttagaattttgacgttgttccgcaaaaagtttaactggcaatggaattttcgggtgcattgtgccttcggttatttgggcttttgcgacaggatcgcaagctaaatcatcaatactgagattttcatcgacaatctgattaacaaaagagctgttcgccccgttttctaataaacgacgaaccaaatatgctaagagcgtttgataagaacctacaggggcataaattcggcattgaacattgagattatgtgagccaacaacttcatcatacaaagtttcccccattccgtgtaagcactggaactcaaaatgtttaccctgtgctaaatggtaaatggttgaaagggtttgagcgttatgggtagcaaattgcggataaatcacatcttgtgccgacaataattttttcgcacaaacaacatagtttaagtctgtatggactttacgagaaaatacgggataaccttctgcaccatcagcttgagcgcgttttacttcgctgtcccaataagcccctttcactaagcggatcatcaatttacggtggttcgcacgggctttctcaatcaaataatcaatcacataaggacaacgtttttgatacgcctgaaccacaaaaccgataccagcaaagtcagctaaatcaggatcggcaatcaagcggtccatcaaatccaaagaaagctctagacgatccgcttcttccgcatcaatgttcaaaccgatgtcgtactgtttagctaataaaaacagatctttcaaacgtggataaagttcatcaattacccgcttgtgttgagctaaactatagcgagggtgaatagccgagagcttaaccgataccccggaagatttatacacccctagaccgcgagaaaccgcccccacagcgtgaatagaagcaacataatcatcataatagcgtttagcatcttgttctgtgaatgccgcctcacctaacatatcgtagctataacgataccccattgcgaaccgcttctcgccatttttaatcgcctgctgaatggtttcccctgtcacaaattgtttgcctaacaaacgcattgccacatcaacccctttacgaataagcggttctccgcctttttgaataaggcgagaaagcgaagaagccagactactttcactgtgggtagctaccagtttacccgtaacaactaacccccacgctgccgcattgacaaatagagaagggctattgccaacgtgggaacgccaatcccctttggcaattttgtcacggattaatttatcggctgtcgctttgtccggaatacgcaataacgcctcagcaagacacatcaatgccacaccctcttcactagacagggaaaattcgtgcatcaacgcatcaacaccactggctttctgacgagcatttctgactttttcaacgagttttttagtaagcgttttaatgccttcgacgtgttcatctactctagcttgcggaataagttgtttgacgagttgctcttcatcacaacgatagtgttcacttaacgttgggcgaatagcggtaccttgaggcaaaatatgataatgagatgtagctgacattgtttttctcccgtttcattgttgttattgagatgattgcaaaatatcactgcaatctcaccgcttgttaaaagcaaaaaacggcttgccaaatggcaaaccgtttctagataaattatttcattgcatctgcataggctttttcagctttatcaaacgtttccacgatttctgctttaggggcaggggtaatcaaagaaaccacgatgattgcgataaaggcaaggataaagccggggatcatttcgtagacagcactctcaggtaataatttatcccaaaataccaccactaaagccccgactaacattccagccattgcaccagccgcattcattcgcttccagaaaagcgaaagaataaccacaggtccaaaagcacagccaaaacctgcccacgcattttcaactaattttaatacttggcttgttggatcttgagcaatggcaatggcaatcactgaaatcacgagaaccataatacgacctaaccaaactagctctttttgacttgcatttggtctaatcatacctttatagaaatcttctgtaatcgcacttgaacagatcaacaactgacaacttaatgtactcattaccgctgctaaaattgctgataataaaatcccaacaatccaaggattaaagagtaatttagataattcaataaagacttgttcattattttgattaaccacagccgcctgttcaggatttgcgaagaagtaggcttgcccaaagaagccgatccctaccgccccaaataaacagataatcatccaagtcatactaatacgacgagcatttggcattgatttcacactatctgcagccataaaacgagctaaaatatgtggctgaccaaaataacccaatccccaagcagctaaacttaatagaccgacaaaggttgtgcctgtgaatatatcagtaaaatccttaccgacatattgccctgcagcaataatcacattatgcgtatccgcaaagccacctaaatgaattaacacaaaaataggggttaagaaaagagcaaataacatcagactagcttgaatagtatccgtccagcttaccgctaagaaaccaccaataaaggtatagatgatagtggctaatgcaccataccataacgctgtggcatacggcacgccaaataaattttcaaataatcttgcccctgcgactacgcccgaagcacagtaaatggcaaagaaaaatagaataatagtagcagacacaattttgaggatttttgtgttatcgccaaaacggtgatggaaatagtcaggcaaagttaaagcattcgtattgtattccgtatgcatacgcaaacgaccagctacaaataaccagttaaggtaagcacctatggtcaagccaattgcaatccagccctcaaccaaacctgccgcataaaccgcaccaggtaaacccattaataaccagccagacatatctgatgcccctgctgataaccctgttacaaaactacctaatcgacgaccgcctaaaatatagtccgataaattattcgtaaatcgataagcaacaaaaccaattaagaccattccgataatataaatcagaaacgtcgttgttgtcggatcaaagccaaacataaggtttctccctagtaatacaaaattctaaactgtccaatatagcagaaatcacagcatcttaacttttccttttaatcaactgactactatttgtcctacatcttaaatttgttcaagtatagaacaaaaaaatttattttgtaacattttttaaactttttaattaaaattatacaaaaatgagagtgttgtatattcactctatttatttgctctaaccgttatcaaggacgcccctttaaaattttccctaaaaacaaaaaaccgcaggctatctctaacctgcggttcttctctttaataaaaccccgacgatgctctactctcacatggggaatccccacactaccatcgacgttacagcttttcacttctgagttcggtatggagtcaggtgggacaactgcactattgtcgtcgggaaaatcttttgatgattctctctatcttcttttttctgttctttaagggcaaatgtaatttgcccctacatctttctgttctttaagggcaaatataatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggacgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcttacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttccggcgaacgagtttttcactcgttttatcgttacttatgtcagcattcgcacttgtgatatctccagcatacttctcaatacaccttcatcgacttacacaacgctcccctacccaacagacgtatcacaaatattcctctgatttctatccgcactttatgccaactcaacgtgttgggtgcttgaccaacatcttattccgtttcacttcattcgatgttgttaatcgtaaggcgtatttgtgatacgcctgatgccgcagcttcggtgctatattttagccccgttacatcttccgcgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccactgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacaaaaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaaccatacaacctcaaacattttcacttgaagttgatattaactactaaacacttgactgcttttgttcagtcaagatttttcttactactcagactttcttgtttcagggcaaatgtgatttgcccctacagaaaatctctcagttttcagcttgtttccaaatttttaaagaacattcgataatcacttatctttcgacaaaaaatcatctttaaatggcgtccccacggggattcgaaccccggttaccgccgtgaaagggcgatgtcctaggcctctagacgatggggacaacatttaaagatgctttccttcatcctgtcaatttgcaaattttatcgcaaatctgaccgcttgtgtctgttttcttgctctattccttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcgccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacactctcatctctgaaagcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaggtggcccgaaagtcccaccctctagtccttagacattacgcggtattagcgacagtttcccatcgttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaagtttaatcgctcaatatgtactgactataaaaaaatcacgactgaatttattcaatcattatgaatttcaagttaagcacctatcaagacttcaaaattaaaaaaatatttttaaacaaagtcaatcaacaagtgcccacacagattgtctgataagttgttaaagagcaaaaaagaacgacgcactgtcaaatttaactacttcacaacagcgcgtcgttgtgtggtgcgcattatagagaaattcaaaaccaacgcaagtacttttttaaagttttttctaaatgttttgtttttcaccaaaaataaaaaccacaagatgtaacctattgattttaaacaaaattattttcaacaaaattcagtatatttaagcgtttaaatccccaattctgcattaccttttctctttttaggaagtcttcactattttgcgtacaaaatgcctgattttctttgttttcgttattcacattcctcttcacatcttgtaacaagctcactacacggttcgcaatcccattgcccggatcaacaaaaaaactcacccgtggcaatagttgttgcaactcttctttgaccaatgggaaatgggtgcaacctaaaatcaccgtatctagcgtcgggtgtgattgccattcttcaacaactttttgcaagcgtcgcatatccaccgaacccgtttgctgtttttcttcgacgatttccaccaaatctgttgagccaatgcgttctaccacacaatcttttgcatagcgttcaatcaactcatcgacataagggcgtgttaccgtgcctttggtcgcaagcaaaccaattgttttggtttgagaaatttgagcggcaggcttaatcgcaggcacagtcccgacaatcggcattgcaaaccgctctcgtaaggcaggtagcacaaccgtactggcagtattacaagcaacaaccaccatatcaagcggataattttctgcaattttttgcacaatacctaccgctagttcgatcagcaccgcttctgatttttcagaataagggaaatacgcgttgtcaaaacagtagagataatgggcatctggcagattttcacgaatagcatcgtaaatagtcaaaccacccattcctgagtcgtaaagaagaattgttggtttcattatattttgtaattaaagaacttcgagcgaatgctacgcctttcttgatgtggtttcaaatgaaaattgtggcagaaacagctctcgaatttctaacggataacctttgagtagcaatgttgaacggcgagcatataagcccgtctgcttgtcttggctccattccaaagttaaacgctgtggattttgcggaaatagccacaaaccaataggattatctcctagggttaaaacggcttgtgccacattctcaattgtttcttccgctaatagcgtttgagcaaaaatccacaccttatcatcaccacttaacaccacttctcgcacccacgtttttgcaaaatattgctcaaatccgaccgcttgccagccctgttgaacaacttcaacgtctagcctttgacaaatttgttgcaacttttcggttaaagagttcgtatgtaacagccattctgcaacttggcttggcaaacccgtttccgccgtttgccaagcagatgtggctaataaggttcgatactgctcgaaatcctgcatttaagcccctagctgtttgagcaaaatctgctctaacacatcatagccttgctgagtaaagtgcaatccgtcgtgacacagatttaagtccaatttgccttctttattagcaaaggcattccatgttttcacataacgaatatcggcagggcaatgtgcttcaagatattgatttaacgccaaaatcgcaggattgtccgtggtcgcaatgttattcacaggggttgcttctaataaatagtagcgagatgttggggctaatgttttaaaggcggacacaatctcgttaatccaatctaacacttgctttggcgaataatcaggttcttttacaatgtcattcacccctaaaaagataaacacatcttcgcctaactgtttgattaaattacctttaacaatcacatcaaggtattgacgggtgctagtgccggacaaccccaaatttgccaccgttttacctgcaatatacggcgtgccttgttccatatctgaccacatatcaaatagtgagtgaccaacaagggtgatttgagcttttttatcaaactcagcctgtttgcttaatgctctgtctaaaatgtcttgatctgttttcataggttatcctttgtctaaagtaatgattaaaaaccatcctacacaacaaaccccactttcttatacacgtcggctaaggttgctttcgcttttgctctcgctttttctgcaccttcacggtaaatactttcaagcaatgcttcgttgttacggaaatggtgataacgttcttgaagttggcttagcattgcggaaacttcgtcggcaacggcagtttttaagtgaccgtacattttgccttcaaattctgtttctaattcaggaattgtcttgcctgtgacgcttgccaaaatatcaagtaggtttgatacgccaggtttattttgaacgtcgtaacgtacaacaggtggctcatcaccgtcggtcattgcccgtttgatttttttcgccactgattttggatcttctaataaaccgataacgttattacggttatcatctgattttgacatctttttcgttggttcaagtagcgacataattctcgctcctgttttggcaataaagacttcaggcacagcgaagattggctcaaggacatttccctctgcgtcttttttgccgtataacgcattaaaacggttagcaatatcacgggtgatttctagatgttgtttctgatcgtcgcctacaggcacttgatttgcttggtacagtagaatgtctgccgccattagcactggataagtaaataagcctacgtttacgttatcttcgtggcgagctgatttgtctttgaattgtgtcattcgccccatttcgccgaagtaggtataacaatttaagatccaagcgagttggctatgttcaggaacgtgggattgaataaaaatagtgcttttggctggatcgataccacaagcaaggtaaatggcgagtgtatctaaggttgctttgcgtaacgcctctggatcttgtcgcactgtgatggcgtgtaaatcaacgatacaaaatagacattcatattcatcttgcattttaacccagttacgtaatgccccaaggtagttacctaaacttaattcgcctgatggctgtacgccactaaatactattggttttgacataatctttctctttttagtaaaaaatctagcggtgtgattttggcagaaatttgctaaaaatgccaagtattcaaccgcttatcattttaggaattaatcctcaatccccaaactttcccagatctcatcaacacgtttgacgacatcgggatttttggtaatcggcgttccccattctcgttgggtttcacctgcccatttatttgtggcatcaatgcccatttttgagcctaatcctgcgataggggacgcaaaatcaaggtaatcaatcggtgtgttttcgattaatgtcgcatctcttgctggatcacaacgggtggtaatcgcccagattacatctttccaatctctcgcattgacatcatcatcacacacaatcacaaatttggtgtacataaactgccgtaaaaacgaccaaactcccatcattacccgtttggcgtgtcctgcgtattgttttttgatggtcactaccgctaggcgataagaacagccttcggacggtaagtagaaatcaacaatttcagggaactgcttctgcaaaatcgggataaacacttcattcaaggcttcgcctaagactgcaggttcatctggcggtctgcctgtgtaggtggaatgatagatggcatcttttcgcattgtaatatgcgtcacggtaaacacaggaaaatactcttgttcattgtaatatcccgtatgatcgccgtaaggcccttccaacgccgtttcgttaagatcgatatagccttcaagcacaatctcagcactagcaggcacttccaaatcattgctgatggatttcaccacttcggttttatgtccacgcaataaccctgcaaaggcatattccgataaagtatcggggatcggcgtaacggcggctaaaatcgtagcaggatctgcccctaatgcgacagaaacagggaacggcttatcagagttagcttctttccactcttggaaatccaaggcaccgccacgatgtgacagccaacgcataatcagcttatttttgccgattaactgctggcgataaatccccaaatttaaccgctttttataaggaccttgtgtaatagttaaaccccaagtgacaagcggtgcgacatcgccttgccaacagtgcataatcggcagttgatacaaatcgacatcatcacctgagatcaccacttgctgacaatctgctttattcaacaccttacttggcatattcagcacttgcttccactgtggcaactgtccgattagatctttaaagccttttggtggttcgggttcttttaagaacgccaacaatttgcctagctctcgcaaggctttggtatcttcttgtcccatacccattgccacccgttccggcgtgccgaacagattgcacagcacaggcattttgtagcctttcgggttttcaaataagagagctggaccgcctttactcaaagtacgatccgcaatctcggtcatttccaaataaggatcgatctcttgaataatacgcttcagttcgcctttttgttcaagcagatcgagaaattctcgcaggtttttgtatttcatttgattctccattgcaagaaaatgcaattttaataaaatttctaatctagagaaataaaagagctgaccccagtatgatactgaaatcagcccattaaaactatctatttaaagatatagccacaatatttggaatataatgcaataaatacaactaaactatttacttaaattatcaaagaagtttttcacccctttgaaaaaaccttcgtgttttggtcgatgttgtcctttgccttccagactttcttctaatttacgtaacaactctttttgttcttcattaagcgatactggcgtttcaataatcactttacagattaaatcccctgcatagccgcctcttgcactggttacgcctttaccacgcacgcgaaacagtttacccgtttgggtttcggctgggattttgagtttcacgcgaccgtctaatgtcggcacttcaatttcgccacctaatgccgccattgtgaagctgatcggtacttcgcagtaaagatttgagccgtcacgcacgaaaatatcgtggtctttaacgtgaattaccacatataaatcccctgctggagcgccgttttcccctgcagccccttcacccgataagcgaagttggttgccagtatccacgccagctggaatggtgaccgaaaggtttttagttttctcaacacgtccgtcaccgtggcaagatttacacggtttatcaattttcttaccagtgccgtgacaacttgggcagacagtttctgtcataaagaaaccttgttggcgacgaactcgtcccgagccgtgacagtgtggacaggtttcgaccttgctccccgcttcagcaccagaaccgtggcaagtatcacattgaacaagagttcgaatgcgaatatcttttttcacaccacgcacggcttcttcaagggtgatttctagatcgtagcgtaagtcatcaccacgcacgacacgttggcgacgagcgccaccaccaaaaccaccgccaaacatttcgctgaaaatatcttcaaagccgccgaaaccgccaccaccaaatccgccgaagccaccagctccgccatcgtgttcaaaggcttggtgaccgtactgatcgtacattgcacgtttttcgttgtcgcctaacacttcataggcttctttgatctctttaaatttttcttcagcttctttgctgccttggtttttgtcggggtgatgttttgccgctaaacgtttataagcacgtttaatctcttgttcactcgcccctttttgtaagccaaggacttcgtagtaatcttttttactcatagtattttttgtaaatttttaagaaaatttgaccgcttgtaacctaatttcgttatattctgttttctaacgaaaaaatctgcttatttagaatttcatcaattttggctcgatccaaccctgaatttatcaaagtgagttctaacgttttcatttgttgtttaaatgcttcttttgctttatgtacattttcagcaataaaatcagcattgagatcgctttcgatacgataaaatttaatgttggaaacacaaggataaaaccaatcaaatttagcagttaaatcctgaatagcaatagtgccatgtgcttcactaataccttctttccccaaataaacacttccttgtagatgttcaaaaccgtgtttttcaagcgtatttcgaatatcgtagtaagcgttattatgggtatttccatggtaattatcttttagacaatttgtatccatatcaaaagtgattaggtatctactcatattcaatttccaatagttagattttatctaaaatgttttttgatgataattaggacataatcaacgcagttttcaacggtatcatcaccatttaacttttgagcctgtatttcgagttttctttcgtagatatacaccaaaagggcgtgttgccacgccctttgtagggacgcagtgcctgcgtccgtggacacacgcagtgtgaccctacccgtaaattacttgttgtctttcacttcttcaaactcagcatctaccacgccgtcatctttttgactttgttgggcttgttgctgaccttgttgagcctgagcttgacctgcttggattaacggctcagacgctttcactagggcttcgattttcgcttcaatatctgctttatcttcgcctttcgccgctttttctaatgccgctaccgcttcttcgatcttcgctttgtctgcatccgcaaggttgctacctgcttcagcgatctgtttacgggttgagtgagcaatcgcatccgcttggttgcgagtttgaactaactcttcaaacttacggtctgcttctgcattcgcttccgcatcacgcaccatttgttcgatttcagcatcgcttaagcctgaagaggcttggatcttaatttgttgctctttacctgtgttcttatctttcgcagacacattaataataccgtttgcatcaatatcgaatgtgacttcgatttgtggcataccgcgtggtgcagggttaatgccttcaaggttaaattgacctaatgatttattatctgctgcacgtttacgttcaccttgtaatacgtgaatggttaccgcactttgattatcttccgccgttgagaacacttgcgattttttcgttgggatcgtggtgtttttctcaattaaagttgtcattacgccacccattgtttcgatacctaatgataacggggtgacgtctaacaataatacgtctgttacatcacccgctaatacgccaccttgtactgccgcaccaatagctaccgcttcatctgggtttacgtctttgcgtggttctttgccgaagaagtcagccacttttttctgtactaatggcatacgggtttgaccgccaactaagatcacatcgttgatctcagatacccttaaacctgcatcagctaacgccacttttactggctctaatgagcggtttactaaatcttctactaacgcttctaatttcgcacgggtcacagttaaaaccaagtgttttggacctgttacatctgcggtgatatacggaagatttacttcggttgattgtgctgatgaaagctcaattttggctttttccgcagcttctttcacacgttgcattgccattgagtcattgcgtaaatcgacgccttgctctttttgaaattcttcaacaaggtagttaattaaacggttgtcgaagtcttcaccacctaagtgagtatcaccgttggttgcacgcacttcaaaggtttgttcgccatctaagttatcaatttcgatgatagacaagtcgaatgtaccaccacccaagtcatacactgcaacaatttggttttcttttttagagtctaaaccgtaagctaatgccgctgctgttggttcgttgatgatacgtttaacttctaaacctgcgatacgacctgcatctttagttgcttgacgttgagcatcgttaaagtaagcaggcacagtaataaccgcttcagtcactgattcacctaagaaatcttctgcagttttcttcatttttttcaatacttccgcagagatttgcggtggagccattttttcgccttttactgatacccacgcatcgccattgtccgctttggtaatctcaaacggcataatttcaatgtcacgttgtacttcagaatcagtaaaacgacgaccgattaaacgtttaatggcaaataaagtatttttcgggttagtgatcgcttggcgttttgctggctgaccaactaaggtttctttgtctgtatacgcaatgattgacggagtagtacgcgcaccttctgcattctcaattacacgtggtttgtcgccatccattactgcaacacaagagttggttgtacctaagtcaataccgataatttttcccataatttgattcctctaatataaatttggttgtttgtttaagttagctacaagattgtgctttttcgctacatttcaagagcaattcaaacatttttcaaaaaagaaacgggaagttgtgctacgttcccgctcagacggaacaataaatagggataaaaatgtgggcttcaaggggaaaactaaaaaaatttaaaaaatgtgtattaacacacacactatttctcactacggcacaatcaccgtaaacacataagccgccatattaaccaaaagcactacgccataaagcatattcgatttgccgtgattaagagaaaccatcacaacgaaagcggacaatgccagtagcaccattgatttccaatctaagcctaacaccatattaatatcaaatagtaagcagacgatcacaacagacggaatagttaaaccgatactggctaacgctgaacctaatgctaaattcacactggtttgtaatcggttacggctggctgcggtcaatgctgccaaaccttcaggcatcaaaacaacagcagcaataatcaccccgactaaagataacggcgcgcctgcagcaaccaccattgcttcaatcgcaggggaaagccctttcgccagcattacaacgacacctaaacagatcactagcagcaacaaactgaccaatgctactttagtcgaaggtggctctgcgtgatggtttggattatcatcatcggctaagaaataatcacggtgacgcacggtttgcatcataataaaagagaaatataaaacgagcgaagcaatcgcaacaaataccaactgagaactggtataagttccccctgctgaactggtggtgaaattaggcaaaatcattgttaataccaaaatagacactaaggtcactaaagcggtactcactgattttttatgaaaaaattgaacgtgatgtttgataccaccaattaataagcaaccacctaaaatcccattcaaaatcaacataatcgccgcaaatacggtatctctagccaaataggtagcattgtcacccccagcgatcatcagcgacacgattaatgccacttcaataatcgtaatagcgagtgctagaataatagtaccaaacggctctccaactttatgtgctaccacttctgcgtgatgaactgcagaaagcacactaccaatcaataacgcacctcctccaagttgtagccaaatgttctctttcacgccaacaaaatagatagcccaagctgcaagcggtaagatcaccgaccaaattggcaaaggggaatgggaatgtgtcgccataatgtcttctcctttatttttatcgtttaacaatcctgctcttttgtactcataatctcaataatttgtctatccatatagaccatactttttgtcgcaatcgcacataggttattgattgatttatcaacgctatgttccacgataccttcattgccagtcactcggctattatctaacgccattaacaccgctttgtaggaagatgatacccctgttgaaactttcatcgcacagctatttgccgccccatcacacaatacaccgctgatgtcgccgatcatactgcaaatcgccatactaatggcgttaaaattacctttcagcaaatatgccatacctgccgcactgctcattgccgccgtagtcacagcacaaagagccgacagttttggcaacttactatgaatatagattgcaatcgtatgagaaagaaataacgcacggatcagttgctcatcatcggcattcacaaaacgtgccacaatcactgacggcattgttgccgcaatgccttgattgcccgaacccgaattgctcatcgccggcaacaagacaccgcccattcgagcatcggatgctgcggtagtttcaattacaatgcgtgacaataaatcatcagacatcaacccaagttcaatctgctttttcaaggttcgcccgatatgcaagccatactctttttctaaaccttctttcgataacgcagaatttaatttagcagcttcggcaataaaggcaatctgttcaaggggaacttccattgcaaattgataaatctgttcagcagaaagctgattgaaaaagtgataatcgtctgctgtttcaaccgcttgcgtttgttgctggaacaacactcccccatttttctcaatcaataccacattggtatgagtgtcttgaatacagactttgacccaacccgtttcacctaacaataaagcttccgaataaagcggaaaatccacattcgcaatatccacacttacctgattggtatctaacatcgcttttgctttggcgacatcttcggcttgaatatgtttcaacacttccaaacctgcctccgcatcaccagcaattgcccccacagcagccgcaattggcaagcccaccatacccgttcctggcacggtaacccccataccatttttcattaaattaggggatactttagtctgaatttgaacaggctcgccacctaagtatgatttcgcaattgcagccgctaacgccaacgaaatgggttctgtacagcctaatgctggggcaacatctcgtttcataatggcgattaattgttctgcaaattcaaatttattcattcttttttctctttagtaaaatttctctctattctaaccgcttattgcataatcaaaaagcaacttttttgcttgcttttaattgcataaaaatgcattattcaaacataattattcattataacatttaaatttattttttgataattatcacttgaacgcaaacgtttgctctagtaaacttagccgcctattcctgagtaagagattaggcagcttacaaaatgacagccaaaatttcaataattaggagtacatataatgtctgaacctgccattttagttcttgccgatggctctgtgtttcacggaaaatctattggttatcaaggacataccattggtgaagtggtctttaataccgcaatgacgggctaccaagaaattctcaccgacccttcatacactaatcaaattgttacattgacttatccacatatcggtaatacaggaacaaatagcgaagacgaagaagccgataaagtgtatgctgcaggtttaattattcgtgatcttccccttattcatagcaatttccgtgctaactcttccctttctgattatctggttaaacataaaatcgtcgcaattgccgacattgacacacgccgtttaactcgaattttgcgtgataaaggcgctcaagcaggctgtatttatgtcggtgatgatatggctaaggctctcgaacttgccgacagtttcggctcaatggctgggcaagatttagccaaagaagtgacctgtaaagagttatatcaatggacggaaggtgaatggcaacttggcaaaggttatgtgcaacaaactacccctgaatttcacgttgtcgcttacgattttggcgtaaaacgtaacattttaagaatgcttgcggaacgtggctgtcgtatcaccgttgtacctgcaacaacctctgcagaagctgtactagtcttaaacccagacggtgttttcttatctaacggaccaggcgacccagagccttgcacctatgcaattaccgctatccaaaaattattggcaacgaaaaaaccgattttcggcatctgtttagggcatcaattactcggattagccgcaggcggtaaaacgaaaaaaatggcattcggacaccacggcgcaaatcaccctgtacaagatttagacacacaaaatgtgctgatcaccagccaaaaccacggttttgaagttgatgaagcgagtttgcctgctaacgttcgtgtcacccatcgctcactctttgacggcacagtccaaggcattgaactcaccgatcaatcggcattctcgttccaaggacacccagaagccagcccagggccgcacgatgtggcatacctgtttgaccgctttattgatgaattgagaaaagcgaaaggttaataagcggtgagatttgaagggaattttgcaaaatttcgctgaaaagtgaccgcttgtattcaagtcccctccccctcttgcgggggaggggattaaatagtggtggatattaaaagacaaccaaattcaacaacagagaaaaactatgccaaaacgtacagatataaacacgattttaattattggtgctggtccgattgtgattgggcaggcgtgtgaatttgactactcaggggcgcaggcgtgtaaggcgttgcgtgaagaagggtataaagtggtgttggtgaactcaaacccagcgaccattatgaccgatccaaatatggcggacgtgacctatattgagccgattgagtggcgaacggtggcgaaaatcatcgaaaaagagcgtccagatgcgattttaccgacaatgggcggtcaaacagcattaaactgtgccttagatttatctcgtaacggggtattaaaacagttcaatgttgagctgatcggggcgagtgaagatgcgattgataaggcggaagatcgtggtcgtttcaaacaagcgatggaaaaaatcggtttgtcttgcccgaaatcttttattgctcatacccttgaagaagccttaaaagcacaggaagcggtcggtttcccaacgttaattcgtccatcatttacaatgggcggttcaggtggcggtatcgcttataaccgtgatgaatttttagcaatttgcgaacgaggatttgaagcgtcgccaacccacgagttattgattgaacagtctgtgcttggttggaaagagtatgaaatggaagtggtgcgtgataaggcggacaactgcattatcgtttgttcaattgagaacttcgacccgatgggtgtgcatacgggcgacagcattaccgttgcacctgcacaaactttaaccgataaagaatatcaaattatgcgtaatgcttctttggcggtgttgcgtgaaatcggcgtggatacaggcggttcaaatgtgcaatttgcgatcaaccctgaaaatggcgagataatcgtaattgaaatgaacccgcgtgttagccgttcttctgcccttgcatctaaagcgacaggcttcccgattgcaaaagttgcagcgaaattagcggtcggttataccttacatgaactgcgtaacgatattacgggcggtttaattccagcttcttttgaaccaacccttgactatgtcgtaaccaaaattccacgttttgcctttgaaaaatttgcgaatgcagacgaccgtttaaccacccaaatgaagtctgtgggcgaagtgatggcaatgggaagaactttccaagagagcttgcagaaagcgttgcgtggcttagaaatggggatttgtggctttaacttgctatcggaagagcctgaaaaaatccgtcgtgagctggcaaacccaggcccgaaccgtattctttatgttgctgatgcttttggtgcaggctttagcttggacgaagttcatcactattccaaaatcgatccgtggttcttaattcaaattcaagatttggtgcaagaagagcttgcccttgagaaaaaacagttaagcgatttggatcgtgaagaattacgtcgtttaaaacgcaaaggtttctcggataaacgtatcgcccagctcactaaagtcagtgaaaaagcggtgcgtgattatcgccatacccttggtattctgccggtttacaaacgtgtcgatacctgtgcggcagagtttgcttctgatacggcttatctctattctacttacgaagaagagtgcgaagcgaacccatctgatcgtaaaaaagtgatgattttaggcggtggtccgaaccgtatcggacaagggattgagttcgattactgctgtgttcacgcttcccttgccttgcgtgaagctggctatgaaaccattatggtgaactgcaaccctgaaacggtttcaacagattttgatacctctgaccgcttgtattttgagccattaacgctggaagatgtgttagaagtggtgcgtgtagaacagccgtggggcgtgattgttcattatggcggtcaaacgccgttaaaactggcaaatgctttacacgaaaacggcgtgaatattatcggcacatcagcagacagcattgatgcggcggaagaccgtgaacgtttccaaaaaatcctgcacgatttgaacctaaaacaacccgctaaccgaacggctcgcaatgcacaagaagcggtggcgttggcaaatgaagtaggttatccgttggtggttcgcccatcttatgtacttggcggacgtgcaatgcaaatcgtctataacgatgaagaattgaacaaatatatgcgtgaagcggtgtctgtgtctaacgacagcccgatcttgctcgaccacttcttaaataatgcgattgaagtcgatgtggactgtatctgtgacggcgaaaacgtggtgatcggcggtattatgcaacacgttgaacaagcaggtatccacagtggcgactcggcgtgttctctgcctgcttactcgttaagcggtgagatcctcgatgaaattcgcagacagaccaaagaaatggcgtttgcccttggggttaaaggcttaatgaacgtacaatttgcggcgcaaaatgatgtggtatatgttcttgaagtaaaccctcgtgccagccgtaccgtgccgtttgtgagtaaagcgacaggtcagccgttagctaaaatcgctgcacgagtaatggctggggaaagccttgcagaactcaatgctctggaagaggtaattccacaaaaatacttcgttaaagaagcggtgttcccattcatcaaattcccaggggtagatacaattttaggccctgaaatgcgttcgacaggggaagtaatgggcgtgggcgaaacctttgccgaagccttcttcaaagcacagttaggagcaggggaacgtattccaagaacaggaaaagtgttcttatcggtagataacaacgataaacctcgcttactcgatgtggcaaaacgcctacaagagcaaggctacggcttatgtgcaaccttaggcacagcaaaattcttacgcgaaaacggcattgcgacccaaatcgtgaataaagtgcgtgaaggcagaccacatatcgttgatgcgattaaaaacggcgagattgcgatggtgatcaacaccgtaaacggtgagcctgaagtgattaccgacagccactcaatccgccgtaccgcactgcaacaacgtgtgcctgtctataccacgattgcaggagccgatgcgatttcctatgctgttgaacatatcaacgaatttgaggtttattcggtacaggagttgcatagtaactagattataaaaagaagagcttgaatatactttacaaaactaatgttattcaagctctttactaatctagttagacagattattaatatggatattaggcatagtacacaattttaataaataataccccaatactgcggagatacctgaaccgattaagattcctaaacgagcaagagagataaattgaccgtcagcttcatcttcaccaaaagcaagtcctgccaagaacattgacattgtaaagccgataccacaaaggatagaaacagcgaagatttgtttaaaatttatcccttctgataactgtgcgatacccaatttcacggcaaggaagctaaagctaaatacgcctaaggttttacctactaataaacctaacgcaacccccattgtaagcggtgagaataatgtgcttaagctcattcctgctaaagatacgccagcatttgagaaagcaaatagcggtaaaatcacaaacgaacaccacggtgcaaggatatgttcaaaatgagccaatggttcttccccatttttaccttttaatggaacgcagaagccaataattacccccgctaatgtggcgtgaacccctgattttaatactgaagcccataaaattaatccaacgaccatataagcacaaattgccgtaactcgcatacgattcattatgattaaagcagtaattgctatgactgctgaaatcagggctgtggtacttaattcgtgagagaaaaagatagcaattacgacaattgcccccaagtcatcaataatcgctaatgcgagtaggaaaattttcaaagcaaatggcactcgtttgccgagtaatcctaaaactccaagtgcaaatgcaatgtctgttgccatcggaatcgcccaaccttgctgaaattctggcgaatcactattaatcaatgtgaaaacaagagctggtacaatcattccccctaatgcaccaatagcggggaaaattgcacgttggtagctagaaattgctccaaccatcatttcacgcttcacttctagccctataaggacaaaaaacactgccataaagccgtcgtttacccacattaacaacggtttatgaatactgaataagccaatctggatactgacaggcatacttaaaaaatcaaagtagaggtctttcaagggcgtatttgcaaacagcattgctaacattgcaaaagcaagcaataaaataccgcttgcagactctagttgtaaaaattttcggatatgctggatcattctgttaacctcttgttatgtaaaattcgtcaatctttcttaaatcttttttcttttaacaaaatcagcgtgtaagatcaaggcgaagcgggcagatactgcagaaaatttgtaaaatttgtttgatcaacttcacgaaaagtagcaataaaagatttgaatttatgtttggggaaatttctagattagccttgatctttttggtatttatcgctagaattgcaactcttttttatgatcctcgtttggcttatagtcaatttttaatttttaggtagatagcaaatgaaacgtacatttcaaccatctgtattaaaacgcgctcgtactcacggtttccgtgctcgtatggcaactaaaaacggtcgtcaagtattagcacgtcgtcgtgctaaaggtcgtaaaagcttatctgcataatggcagataagtcagccaaaacactcagtgtgaataagctaactttttctcgggagctacgtttgttagctcccgttcaatttaaatcggtttttgaactgcctctccgtgctagcacgcctcaattaacccttttatctcgccaaaacgatattgaacacgctcgaattggtcttactgttgctaaaaagcatctaaaaagagcccacgaccgcaatcgtatcaaacgcattgtgcgagaaagcttccgcttgaagcaacatcaacttcctgcttatgattttgtctttgtggcaaaaggcggaattggtaaactaagcaaccaagaattatttgaaaccttggataaactatggcaacgccacattcgcctcgctcagaaagcacaacaggaacaacatcaaaactaagccctttggcttatgtaatgctcgcctttgtgcatttttaccgctatgtcattagcccattaattggaccacgctgtcgtttttatcccacttgctctacctatgcgttagaagcggttaaaattcacggtgccataaaaggtggctggcttgtgctaaaacgtattttacgttgcaatccattgaacgaagggggggaagatcctgttccgccgaagtgtaattgcggtaaaaaacataaataatattgtaggtcgggcagtaatgctcaacttaatctatcttgcccaataccaacttacccgcaaaacgttgcgttaattgattttgaaacagttctacttgtgtggggttaatcgctaagattaattccaccttatcactaaattgttgctcaagtagctcaatatcccgttccgcaatcaaatgttgaatcgtattaaattgttcatattcacactgcaagcggtaagatttacctaaaactttgcgaattttttcgacttgcaatagcccctgttgtacaccattgccataggctttaacgagtccgcccgtgccgagcaaaatcccgccgtaataacgaaccgccaccgcactgatttcccccaagcctgaacctagcaagtaattaagcattggtttaccagctgtccctgaaggttctccatcatcagaaaagccatattgctgtgaatcattcggctgccctgcaaccgttgcccaacaatgatgtcgagcatgcggatgtaaagctcgtatttcagcccaaaaggctttggcttgttccattccttctgtatggcgaatgtaggtaataaagcgactttttttgatctcttcttcaaagatcacttctgctttggggataaaaaattccatattctcaactgattacttcatagagttccatcatactttaaatgatgagatttgataaatctctttcaaattgttaaaaaaatgtgaaagtcatcatgtttttaagagaaaacgtttgcataacagaaaaaagtcgagtatatcttatatcgttttcctatttgagttataggtcaaacgcaacatcttacttttcccaatcctgaatttttagaggaaatagacatgaaaaacttttttaaattatcgttagttgcaagtttagcaatgggttctatggcagctcacgcagaggacaaattcgtcactatcggtactggtggtcaaacaggcgtttactatgtagtgggtcaatcaatctgccaattagtaaaccgtgacacagcaaaaacgaatgtgaaatgtaatgcgccatctacaggagcatctgttgcaaacttgaatgcgattgccgataaacagatggaaatgggtattgcacaatctgattggcaatatcatgcttacaacggctcaagctcatttaaaggcaagaaaaacgataaattacgtgcagttttctcaattcacccagaaccatttacagtcatggctcgtactgatgccaaaattgctaactttgatgatttaaaaggtaaacgtgtgaatgtgggtgacccaggttcaggtacacgtgcaacgatgaacgttattttagcggcaaaaggttggacagataaagagttcaaagtagcttctgaattaaaaccagcagaaatggcatctgtaatgtgtgataacaacttagatgcaattacttataacgttggtcacccaaacggtgcgctaaaagaagcggcagcatcttgtgatgcacatttagtgccagtaaccggcgaagcgattgataaattagtggcagatcactcttattatgcaaaagcaacgattccgggcggtttatataaaggtaccgataatccggtagaaaccttcggtgtgtatgcaacgcttgtgacttctgcggatgtggatgcggatcgtgtctatactgtggtgaaagcggtatttgataacttcgatcgtttcaaacgtttacaccctgcgtttgaaaacctaaaagaagaagagatgatcaaaaatgcgctctctgcgccattacatgaaggtgcaatccgttattataaagagcgtggttggatgtaattcatccgtttctaatattaaggcaggagtaaatcacttcctgccttttgtcgttttcatcaagcggtcagatttggctgattttttgcaaatttttcgttaaatctaaccgcttgtcttaggttttctcggaggagtttatgtctgctcaatccaaaactatggattacgatgatctgcaagatctcgtcgcctcaaatgattcaggcggtcgtaacccgacaggttttagtaaaaaattaattgttattacagcgattttatggtcgctattccaaatctattacacttcaccatttccattttggctacaagaagtggtgagagattggggctggaatttgaatgtggtggtagatgataccaaagcacgttctatccatcttgcctttgccatgttccttgccttcttgtctttccctgcctttgcaacatcgccgaaatatcgtattcctttccaagattggttatttgcaaccctcggagcgtttcttgctgcgtactacatttttttctatgaagggctagttactcgttttggtgcgccgaatacgcaagatattattgctggctgtttaggcattttattattgttagaggcttgccgtcgtagtttgggtttgccgttagtgattattgcgactgtatttttgctttacaactattttggacaatttttaccgagcagttctatcatcagccaccgttctggttcattatcccaaatcattaaccaacaatggatcaccacggaaggggtatttggtgtcgccctcggtgtttcaaccaaatatgtattcttattcgtgttattcggagctttattggataaagcgggtgcaggtaactattttatcaaaacagcatttgcttatttaggtcactttagcggtggtccaggtaaagcagcggtagtttcttctgcgttaacgggcttggtttcaggttcatctattgccaacgtggttaccacagggacattcaccattccgatgatgaaacgtgtcggtttgacctctgaaaaagcaggggcgattgaagtggcttcatcagtgaacggacaaattatgccgccggtcatgggagcagcggcgttcttgatgattgaatacgtcaatatgccgtatagccaactgattgtacacgccttcttacctgcattaatttcttatattgctttggtgtatatcgttcatcttgaagctcaaaaaatgggcttaaaagggttggatcgtgttgaacctgtcagtccgattttaatcaccttgcttaaagttgtaagctatattttagtaacacttggcttagctattgcggttcattacggcttaggctggattaaagatgttgcccctgattttgccttcttaattgtgtgtattttattagcggcggtctatatcaaattgattcaccgcgtttcacaattccctgatttagaagccgatgatccaaattcactggtcgtatcattaccacgtcgtaaaccaactgtgaacgctggcttacatttcttattacctgttgtggtattaatgtggtgtttgatgattgagcaattctcaccagggttatccgctttctggggaaccgttgcgcttgcggtcattttagtcacacaacgcccattattaagtttcttccgtaatgatgcaggtaacaaagttgtgctagttaaacaaggcgttcaagagttagtggacggtttggagtcgggtgcaagaaatatgattggtatcggtattgcaacagcaaccgcaggtatcattgtaggtgccgtatcgctcaccggtttcggagtgcaactttctggtattattgagatgctctcgatgggcaatatcttattaatgctgattttagtcgctatctttagcttaattttagggatgggattaccgactacggcaaactatatcgtggtatcttcattgatggcattggtgattgtcgaagtcggtaaacagaatggattaatcgtaccattgatcgccgttcacttgttcgtattctacttcgggattatggcggacgtaacgccaccggttggcttagcttcttttgcagcagctgccatttcaggcggtagcccgattaaaactggggtgcaagccttctactacagcttaagaacagcgattttaccgttcctatttatcttcaataccgatttactcttaattgatgtgggttgggcaaaaggtattttagtattcctcaccgcaactatcggtattttgctgtttaccgcagggacgatgaattacttcttcactaagaataaactatgggaaacattggtattaatttttactgcctttatgttattccgcccaggcttctttatggaacacatttcaccgacttcacgccatattgagccttctcaaatggttcaggagttagagaaagtacccgctgggcaaaatctcacattgaaagtcgcaggagtaaacccttatggcaaaccgattgaattctactcacagcttacagtgcctgaaggtgcaacgggcgaagagcgtatcaaagcgatgggattaaccttgctagataccggagagaaaattgagatcaacggcgaaatgtcaccgaagatcttaattgataatgttgaaattgattcagcggcagcgaaagcaggcttaaactgggatcaaaccattcttgatgtagcgttaccacaaagctcgcttccaaaagaattaatgtttatcccggctttcctattagcgatttttgtcggctggaatcagcgccgtcgcataaaaaaataaggacaaattatgtataacaaacttctccttgcgatcgacttaaacgatctcaatagtgctaagtatgtggttgatacggcattaaaactcacggcgaacaatcccgatgcggtatatcgtgtagtgactattattgagccgattgacgacagctttatttctgcgtttttaccgaaaaactttgataagtccgtcgtggaggaagcgaacaaagccttacacgctttcactcaagctaacttcccagagggcgcaaaggttcagcacattgtggctcacggcaccatctacgaagagatcaaccgcattgccgaagaaaaatccgttgatctgatcgtgatgttggcaagcagtaaacctaatgcaaaaggactgagttcgaatacggtaaaagtcgcccgaaatagcgataaaccgattttagtcttgcgttaggtaatcaatacaagcggtgagattttgaagtatttttgcaatttgcaaaatattcacgaaatctcaccgcttttatcattaggaacatcttatttttctgtcggctaaacataacgccataccgaactaaagaaatagccttattcaaaatttcaaatcaagcacttttccgttatacttttcatcaacgagagtaactaaaggagccgattatgaccccatctcaacttattcaagctaaacacactgaaattatggcaatcagccgacaatttgcagtggagaatgtgcgtatatttggttcagtcgccaaaggtaaagacacagaaaatagtgatttagatattttggtagataccacacctaaaacgacaatgtttgatctatgtggtttacaaatggagttggaagatttgctaggtataaaagttgatgtacttaccccacgcagtttacctgaaaaatttcgtgagcaagtattagcagaggcaaaattattatgaggctagattttgtagtagtctatgaaacggctattacatctgtgcctgaattattaactcaaattgaagcattaatattggagacacaaaataagcgctagaattttggaagtatttttgcaatttgcaaaatatttgcgaaatcccaccgcttttgtcattaagaaaatcttattttttcgatctgcgtcgaaaaatgaaaaatatcaacttttcttcttataccagctttctataatgccttttcacttatctcaaaggcagatttatgttacatctagaaagctatcaaaattggttaaaatcacttaaatatcacattcaccactcccagcaacgagctatgcttgcggtaaacagcgaaatggttttactttattggaaaatcggacaagaaattttacagcggcaacaaagcgaagggtggggagcaaaagtcatcgatcaactttcacgagatctcactgcagaatttccagatatgaaaggtttttccagtcgaaacctgaaatatatgcgaaaatttgctcaagaatggactgaatttgaaattgtgcaagaggtgcttgcacaattaccttggtatcatcaaattgctttactagataagctgagtgatgaacaagaacgcctttggtatgctcgcaaagcaattgaaaatggctggtctagaaatatactggtacatcaaattgaaggtcagctattttaccgtcaaggtatagcaatcacgaattttgacaaaaccctgccagatacacagtctgatctcgcaagacaagcctttaaagatccctatattttcgacttcttaaatttaacggaacaacgccacgaacgtgaattagaacaggctttaaccaaacatattacacaatttctattagagcttggtgctggatttagttttgtcggaagccaagttaagttaaatgttgggggtgatgatttctatattgatttactgttttatcgcttaaaattacgttgttatgttgttattgaactgaaaacttgcgatttcaaacccgagcatatcggacaacttaatttctatttgactgtcgtcgataaccaactaaaaacagagatagatacgccgacgattggactattgttgtgtaaaaatcgcaataaagttgttgtgggagaggctccccattacccattggcgttgcagaatatcaacttcagcaactgttggctgaatttgatatggaataatcctacttcagttctgcgttaggcaatcaatacaaacggtgaggttttgaggtatttttgtaatttgcaaaatatttgccgaatctcatcgttttgaattaatcagacagacacatcattttaaacgagtctgtctgattaggtttgctcttctacagataaagtatatcaattttagtttctatatgctttatccattgccataatcacttctcgcacgacctttttttgttcttttggtaagtttaggaacattttaattaccgtttgatcttgatagcttgtggcttcttcccaaagatgcttacttggctctttttctactctatctaatttataagctaattcttccgataccaaatctgtcacaggtacatttagccattccgctaatgttttaagtctggcggatcttggtaatgtttcacctcgtagccaactggcgaaagcatgtaagccaatcggtttgccgtaatgtcgtaaattaaattcacgttctaataccgaagccataggtttataccctctttcaattaagagagcttttagtttttctgcaaaaagttttttctcgtccatgttgctaagttaatttttaacttaatttttaacgaaagattgatcaaaacttacgtagatattatgatacttacgtttttacttacgttaataattaacttgaaaattacgttctattatgacaatccaaatcaaatccaaacaacgtgtttccgatcacggtgaagtatttactcgaaaagaagaagttaatgccatgttggatctcgtcaaagatgaaacgttaagaattgatgcccgatttttagaacccgcttgtggtgatgggaattttttgattgagattttaagacgcaaattggcggtaatagaaaaagattacgccaaatcacagcgagaatatgaattttacctagtgattgccattggggcgatttatggcattgagttacaacaggacaacgtacaggcttgccgtgagcgactttgcaaatttgccgaacaatcttaccgcttgctatttcccgaaacagtaaacgataccgtcatatccgtgattcgctttattttgagtttaaatatcgtgcaaggcaatgccttaaagatgtgctatgtcgatgaaaataatcaggatttagaacatcaaatgatccgtttttccgaatggtctttttttcttggcggagaaagtggagtttaaaacgccatgattttgaatatcaacatttggtgtttgatcgtgccgagccgtatcagtctattcaagaatatttgccttgttattttttagagatccaaaatgcaaaacctatcgattaactacaatcctgacgtattatcttgtttggcaaatttatctaatgatgaagtgtttacttcgcctgaacttgctaaccgtatgttggatttattaccacaagagttgtttagctcaaaaacatcgacttttttagatccagcgacaaaatctggcgtatttttacgtgagattgccaagcgtttgattaaaggcttagagcatgaaattcctgatttgcaaactcgcattaaccatatttttaccaaacaaatttttggcttagggattacggaactaacttcattattggcacgccgtagtctttattgtagccgttcggcaaatcatcaatatgccctttgtactgaatttgacgatccgcaaggcaatattttctatttacctttgcaacacagttgggaaaatgggcgttgcttacattgtggggcaagccaacaagtttacgatcgtgaagaacatttagaaagccacgcttatgcttttattcatcaacctattcaagagattattccaaattgtcctatgaaatttgacgttattatcggcaatccgccttatcagttgagtgatggtggggcacaagcgagtgcgaaacctatatatgatttatttgtagagcaagctaaaaagttaaatccacgatatttaacgatgattattccttctcgttggttcactggtgggaaggggttagatgcctttcgtgacgcaatgctttcagataatcgtatttcaactattcacgattttccgaattcacaagattgctttacgggagtagaaataaaaggtggagtttgttacttcctttgggatagtcattacaagggagattgtaaggttattacccatgctaaaaatgaaattgtctctgaaatggaacgaccgttaaaagaggaagggctagatttctttattcgttataacaatgcaattactattttaagaaaagttgctgaatttaaagaagaaagttttagccaacttgttagtgcaagaaagccttttttcttccctacaaattttaaaggaaaaacgaccgcttatagaggtattgataatgtaacagtctatcaaaataaaagtattggttacgtgaaaagagaagatgttgttgtaaataaacaatggattgatgctcataaattatttgttcctaaggcaataggctctggcgatagtaaaactgactgggtcaagccgatttatgcaggaatgggaacagtctgtacagaaacttatttgttaataggtacatttgatagtcaaaaaacgtgtgaaaatgtgatgagttatatcaatacgaagttctttcactttatgttgacgataaagaaaaatactcaagatgcaacaaaaaaagtttatgagcttattccaacacaagattttactaaaccttggacagaccaagagctttatcagaaatataacttaacggaagatgaaattaactatattgaagcgatggttcgtccaacgggagagaaagaatgagtgaatttatttctgaattacgtaccccaaaagtttacgcatatagcgacagtcgtttcccccattgcttaaaaatcggctataccacaagagatgttgcacagcgagtggcggaacaatatcctgtgaaattgcccaatcaaagctatcaagtggtatttgacgaacgtgccattcgtgatgatggttcaagttttcgagattacgatctccacgctgttctgcaaaaaagaggggttgaacgtttagagggcgagtggtttaaatgcgatttaaacgatgtgaaatctgcttatttaaaggttaaaacaagacaagcggtcgaaaaacagcggacttttgcatttggtatgcgacctgaacagcaagaagcggtaacgaaaacagctcaatactttcgttcgtttcacaacgatgaaaataatcaagaaaaaacaccgcattttttgtggaatgccaaaatgcgttttggtaaaacctttgctgcttatcagcttgccaaagaaatgggttggaaaaagattttggtgctgacttttaagccagcggtacaaaatgcatggcaagaagatttgcaaaatcaccttgattttcaaggctggcgatttgttacccacggagatgaatggcaaagtgcggtggattttccacaaatttgtttcggttctttccaagattatttgggcaaaaataaagcaggcggtacaaaactcaaaaatgagtgggtacatacaatcaattgggattgtattatttttgatgaataccattacggtgcgtggcgtgaaaaatccaaaggtttatttgaagcggaagagcaggcgttccaaaagcaacttgaagccgaagccgccgaaatggaaatggatatgcccgattattttgatgaagaaaccttgccgattaccagcaatcactttttgtatttatcgggtacacctttccgtgcgttaaattcgggcgaatttattgaagagcaagtttataattggacttactccgatgaacagcgagccaaaaaagcatggcaaggggaagataatccttatttaagtttgccaagaatggtaatgcttacctaccaattacctgaggatattcgggaagtggctttaaaaggcgaatttaacgagttcgacttagggcagttttttgaagcaaaaggaacaggcaaaaacgcaaaatttaaatatgaaaatgaagtacaaaaatggcttgatttgattcgtggtgctttgcgttcaaccacaatcgataatctcaaattaggtgcagaaaagccaccaatgccttttggcgacagccgtttattaggcagtttgttgcacacgctatggttcttgccgtctgtggcttcctgttatgccatgcggaatttattgactcaaaagcaaaatcagttttatcacgaatatcaagtgattgtcgccgcaggtaatgatgcaggcatgggggcagatgcgattattcctgtacgaaaagcaatgggtgaaccgctgaacagtaaaaccattacactctcttgtggcaaattgactacgggtgtttctgtcgcaccttggacagggatttttatgttacgcaatttaaatagccctgaaacctatttccaagcagctttccgtgtgcaaacaccgtgggtattacgtggacacaatccaaacgatcccaataatgaatgtatcgtcaaagaagattgttatgtgttcgattttgcccctgaccgtgccttaaagcagttggcggattattgtgtgcgattaaatacagacgataaaaatcctgagcagaaagtcgcagagtttattcaattcttgcctgtgcttgcttatgatggcagttcaatgcgttctattgatgccgccggtattttggatatggcgatgagtggtacaacagcaacgcttttagcacgccgttgggaaagtgctttattggttaatgtcgataatgaaacattaagtaaattacgccacaatgaagatgccatgaaggcattaatgagtattgaaggttttcgttctttgaaccaagatattgaaaccatcatcaataagtcagaaagcgtgaaaaagacaaaaaatgcagcgaatgatcgtgaattaacgcctgatgagaaaaaaacactcagtgatgacgaaaagaaagagaaaagtttacgaaaacaagtacaagaaaaattaatcaagtttgctacacgcattccgatttttatgtacttaaccgacaaccgcgaatacagcttaaaagatgtcatcacacaacttgaacctgaacttttctataaagtaacaggcttaacgcaaaaggactttagcttattggtcagtttaaatttatttaatagcggacaaatgaatgatgctgtgtataaatttaagcgttatgaagatgccagtttgacctattcaggcttaattaaacatcaagaaagccgaattggtttatatgacaccacaattagtattcaagagtacagaatggattaaggggttcttctttatttcattgatacaatatcggatttttctattaaaaatgctagaaaatagcctgtatactgaaacatacaggctgattacaaaatttaaggcatagcaaaaaatcactgctatgcctaaattttgtaaataatttgctcaatcccaccgcttacccttcaaagggattaaacaccttcacgcctgtgcaagcaaaatcagcagagtttcgagtgactagcgttaagttatgttgaattgcactggcggcaatccacgcatcattttcaggcgcgtgatcagggatatgtaatttagcacagatttgggcggtcttttcgtctattttcaggattttgccgtgaaatgtcggtaaaaccacactatcaagccaagttcgtaaaacagccccttggcgaaaatccttatgttctttcgccaaaataccacgctcaatttccatcaagacaacagcgttgataaaaatatcttgtgctgagatcgttgaaaaccacgcaacaaaattgggattggctttaccttgtttgattttacgaacttcgctcactacatttgtatcaagtaaatacattttcactcctagtcttccaaatctacaagacgacgctgtccacgactgcgtggttgtaattcaagctcaatgtcttcattatcaacaggtaataaagcttccaaagcggaacggaacggcttcgcctgctgtactttttcatattcccgatatgtcattaacacaaatgcaggtgtaccacgattggtaatgatcacaggttctagcatagcggctttttgagcttggctaggacgttgattaaattcacggctggttataactggcattttgtactctttcaatgtagttaagtagccacaatcttactgcgattgacgaaatagggcaagcgtaaaaagtggaatatgatttataccgttcaattactcttattttgtttcagcgttgaaaccatttttacgctacaataatgccattcaacaaaatgacttttgattatcaacaatgaaaaaactcaacattatttttgcaggcacacctgattttgccgcaacccatttacaagccttgttaaattcggaacataacgttattgctgtttatacacagccagataagcctgctgggcgtgggaaaaagctacaagctagtccagtcaaacagttggcggaagcgcaccatattcctgtgtatcaaccgaaatcgttacgcaaagaagaggctcaggcagagttacaggcattaaatgctgatgtgatggttgtggtggcttatggcttaattctgccagaagcggtgttaaaagcgccgaaatatggttgcttaaatgttcacggctcgttgttacctcgttggcgtggggctgcgcctattcagcgttctatttgggctggtgatacggaaacgggtgtgaccattatgcagatggacattggcttagatacgggcgatatgttgcataaggtgacaacgccgattttagcgacggaaacgtcagcaagtctttatgccaaacttgccgaacttgcaccacccgcattgcttgaagtattaaacggtttaacaagcggtcagtttaagcctgaaaaacagcaagacgagcaagcgaactatgccgaaaaacttacgaaagaagaagcaaaattagattggaatatgaccgcttgtcagcttgaacgtaatatccgtgcctttaatcctgccccgatggcatatttaaccttgatggtgaatgaggtggaagagcggataaaagtgtatcaagcggaagtgctaccacatcaagagaaagcggtcggcacggtattggcggtggataaaaacggtatccaaattgccacgcaacaaggtgtgttaaacattacccaacttcagccagcaggcaaaaaaccgatgtccgtacaagattttttaaacggacggggggattggtttaaggtaggaagcgttctctaatgaaaaaacattccactcgtgccgttacggcacagattattttacaggtgttggatcagggcaaatccctttcaaccttgatccccgaagcacaatcgcaacttgatagtaaagatttagcgtgggtacaggaaacgacctttggtatttgccgtgtgttgcctcgtttagaagcgattatcaaattattggtagaaaaaccgctgaaaaacaaaactcgcttggtgcattgtttgcttttggtgggcttgtatcagctactttatatgcgagtaccgccccacgctgcggtagatgaagtggttaattcgacaaaagtgttaaagttagatagctttcgagccttgactaacggggtgcttcgccgttttctgcgtgagcaagaagcaattttggcgaaagtggataaacattggcaaacgctacaccctgaatggttggtgaataagctgaaacaagcctatccgaattggcgagagattgttgatgcgaataaccaaaaaccgccgatgtggattagggtgaatactcaacggactaaccgagcggactatgtggcattgttgggtgatcttgcaaaaaatcacaaagaagcgaccgcttgcgtgcctgattgtgccgttttattagataaagcggtgtcggtcagccagcttccccactttaagcaaggctgggtggcagtgcaagatgcacacgcacaatggtctgccgaattacttgacgcacaaaatggcgagttgattttagatgcctgtgcggcaccggggggcaagacaacccatattttagaaaaagcaccgcaagcaaaagtaattgcattagatattgaagaagcccgtttagttcgggttaaagaaaatttagctcgtttaaaccaaacggcaacggtgatttgcggtgatgccagccagcctgaacagtggcttacaagcggtgagatgttcgataaaattttacttgatgccccttgttctgcaacgggggtaatccgtcgtcacccagatattaaatggctacgcaaagaagaagatattgctgagttggcagaattgcagggaaaaattctcaaagcactttgggcaaggctcaagcccaacggtgtgttgctgtatgctacttgttctgtgttaccagaagaaaacagtcagcaaattcagcactttttagctcaaaccccagaggctaaattagtcgaaatcaatgtgggtggcgagcaatgtttaatgaagcaattctttcctaaacaagatgggggagatggatttttctatgcgaagttagtgaaacaggcgtaaaacggtgagtaggcaatgaaaatcatcattttaggtgcagggcaagttggctcaacactggcagaaaatttagcgaataatgataatgacatcaccattattgatgatgatcagcaacgtttagctcaattgcaagataagcacgatttacaagttattcgtggtaatggggcttcacctcgtattttacgagaggcgggagcaagtgatgcggatttattggttgcggtaacaaataatgatgaaagcaatatgattgcttgtcagattgcatatacgctctttaatgtaccaactaaaattgcccgtattcgtaattcggattatgtccgtgagcgtgataccttatttaataacgccgtattgcctatcgatcatatcattgcacctgaattattagttacacaggatattttacgccttattgattacccaggtaccttgcagattgcccactttgccgatgaattaattagtttggtgagtttaaaggcgtattatggcggtccgttagttggttatcctatttcggcattaggcgatcatttacctcatgttgaagcccgaattgtgtcaatcttccgtcaagaaaaagcctttattcctcaaggttcaacgattatcgaagctggtgatgaaatcttttttgtctgtgctacgcaacatatcaaagcggtaatggcagaattacaaaggctggaaaaaccacataagcgagtaatgattgtggggggcggaagcattggaattgcacttgctaaagcacttgaggatcgttgcagtgttaaactgattgaacgaaaccaagaaagagccgaaaaacttgcttctaagctgtctaagactttggtgttatgtggcgatgcgtccgatcaagagctgttatttgaagaacatattgagaacattgatttatttcttgctttgacgagcgatgatgaggcgaacattatgtcgtctttgttagcaaaacggttaggagcaaaaaaagcgatcgttttagtgcaacgaatggcatacctacaccttattcaaggcggaactattgatattgctctttcgccacaacaagcgacaatttccgctttgtcaagccacgtccgcaaaggcgatattgttcatgtagcttcgtttaaacaaggtttaatggaaggcattgaagtgattgctcacggcgataaagaaagctcaaaagtggttggtcgcaaaatcagcgagctaaaactgccacagggagcaattgtgggggcgattatgcgaaatcgtgaagtgctgattgcccataaatctacggtgattgaggaaaacgatcacattattctgtttgtgaatgataagaaacagtctgccgaagtagaaaaactcttccagttgagtgcgtttttcttgtaataagtaaggagtaatagaactagtattaacttacctatattgtatctaatacaaaatctatttcgcctctctttctagctgagatgtaagtcacaaataacgggcaaatcttcaaaataaaatagttctatgctcgcttccattttatatgctatgttcgtgtaaataacaatggataaaaataattttatacgtcatataaactccactacatatgtgtttaacaacacattctacttatcttatcaatctaaaattaaaataagtactgattttgaatgaaagagtaaatcaaatttaattattggatttctcttttaaccaccattacttagtttttatattgctaagtttgaattattagacttgatttatatcctgtcattattactatttaagaaagttaaattatcaaagtccgaatattcaagtagccaaagtttattttcggtaatttctgacgaaataaataaaaagcatcatattcggaaacgctaaaggaaaactacgcaaagcgtaaaatccgtaagataaaatggttacaaggagagattactggtaggtacaaaatactaattgtgcataaccataatgagtaaagaaaacgataatattattctgtttataaatgataaaaagcaatctacagaaagagagggaacctcctgtcaaagatggttttatggttctacaaacggatatatcaagatatcttttttcaaaaaatgtgattgtgatcacagaattactttataagcctttaatataatatagacgaaacaggatatttaatagtatatctgatacataaatgcaaccgctgaacgatatattattaataactatttcaatcaactatttataatatattcattacatcttaaaggagaaaactatgattcttggctgcccaaaagaagtgaaagtccaagagtatcgtgttggcttaacccctgcaaatgtgcaatcttatgttgaagcagggcatactgtttatattgaacacggtgcaggtgctgaaattggtttccctgatgaagcgtatcaagccgcaggtgcaactttgactgacaaagcaacactctttgcaaaaagtgatatgatcatcaaagtgaaagagccgattgaatgtgaatatcactacttccgcgaaaatcaaatcctttatacctacctacacttagccgcagacaaaccgcttaccgaaatgttgcttgaacgcaaaattcaatctgtggcgtatgaaaccatcaaaacccctgcaggtttaccttgcttagcaccgatgagtgccattgcaggacgtttggcgaccttagaagctgcgaaatatatccaaaaaaccttcggtggtgcaggtgtgttactcagcggtacagcgggtacaccaaaagcgaaagtggtgattttaggtggtggtgttgtaggcttaaatgcggctcaaattgcgatgggtatcggggcggatgtcactatcctagatattaacgctgctcgtcttgcttatatcgatcaaatctttgatatgcgtatcaaaacactcaccagctctcgtggcaatattttaagcctattaccagaagctgacgtggtgatcggtgcggtactaattccaggtgctaaagctccgcacttactacgtcgtgaagatctcaaattgatgaaaaaaggtgcagtattagtggacgtagcaattgaccaaggcggttgctttgaaacttctcacccaaccacacacaatgaacctatctatgaagttgatggcgtaatccactactgtgtggcaaatatgccaggctgtgtggctcgtacttcaaccttaggtttaactgactcaaccttagaatttggcttgaaactcgcagcactcggtgtgaaagaagcgtgcttgtctgatccagccttattacaaggtttgaatacttacaacggtaaatgtactttcaaaggtgtgagtgatgcctttggtattgcttataccgatccaaaagatgcattaaattaatatcaagctgtgttgtattgatcaagaacattccccctgaataatcagggggatctctcctatccaccatttagggttttccctaaatcaatctcaaattagcggttgtgttagcttgactgagcctactctctgctatttttaaaagaggtatactatgagtgaaaatacaaaacctgaacggcagtcttggtctagtcaattaacctatattttaactgtcgcaggggcgacagtcggtttcggtgcgacttggcgtttcccttatcttgtaggggaaaacggcggtggtgcttatgttttccttttctgtattgcgatgattgtaatcggtattccgatgattttagttgaaaatgtgatcggtcgtcgtatgcaagtcaattccattgatgccttcggtggcagtgcgaatggcaaaaaaatccattctgcgtggaaaattctcggctatatggggctactgggttctgtcggtatcttagcctactatatggtattaggcggttgggtactcacctatatcggtagtttagcaacaggcggcttagatctctcttcgccagtcacaattgaaaccacatctgcctactttaaagataacattcaaaacaatccattaagagttattctttatacgggagtttttgttgcagtaaactactttatcctgattagaggtattaaagaggggatcgagcgttctgtaaaactactgatgccactactctttgtcttcttaatcattatgattattcgtaatgtcaccttacctggtgcgaccgaaggtatcagtttctaccttatcccagatttctcaaaaattacaccgaagctctttgtcttcgtattaggacaagtgttcttcgcactcagtcttggttttggggtattaattaccttatcaagctacttgtctaaacaagaaaatctagtcaaaaccgcaacaattacaggggttattaataccttaattgcccttgctgctggctttatgattttcccatcactctttacctttaatgttgccccgaactcaggaccaacattagtgttccaaagcttaccgattgtgttctcacatatgtgggcaggtacaatctttgcgattatcttctttggtttattaatcactgcggcactcactacatcaattaccatctatgaagttttgattaccgcattgcaagaaaaaactaaactgagccgtaaacaagcgatcaccttgacgttatttggtatctttatcgtgggtaatatcccatcagtgcttggcgataacgtttggagcaatgtcaaaattgcaggtatgagcatttttgatgcgttcgactacataagcggtaacattctcttcgttttaaccgcattaggtagtgcgattttcgtcggctatgtattgaaagatgaggcgaagaaagagttaaataccagtgaaaaattcacaaacatttggtttagctacgtccgttatgttattcctgtactgattattgtgatttttgtgaattcgctttaataggtaatatgaaagcggtgagaaagttgtaaaaaatacaatattctcaccgcttctgtttagtgggtataatagtaaataaaatctaataaaggaggatactactaatctcttaatctatccaaaagctcgggctgagaataaccaacaaggtaaacacttccaaacgtccacaaaccattgcaaacgttaatacccattttgcactgtcgggaatttgagtaaagttactgctgaccgtacctaacgctggtccaaggttatttagactggcaatcacagcgtttaacgcatcgaaagtttccataccacaagcaatagtcgccaaccaacagaccacaaatacaaagaaataggctgaaaagaatgcccacaccccttcaacaatccgctctgataaaacgtgtttacccagtttgatcggctgaataacatttgggtgaataaagcggtggatttctcgttttccttgcaaataaagcaacaacacacggaacattttcaaaccgccgcccgttgaacctgcacagccaccaataaaggaagcaagcactaataacaacggcaagaaagacggccactggctaaaatcattggtagtgaagcctgccgtagtcgaaatagagaccgactggaacaaggcttgaataaaggtcacagagtgatcgtcaaaatagttataaatcagcaacactccaaaacagatcacaaataacgctaactgaaccgtaataaaaaagcggaattcgtaatctttccaatacaaaccaagaaaattcgacttattattgcctttgtagcgatcattaaactgatcaaacaccgcaaaatgcagagcgaagttacaggaagagatcaataagaacagcactgtaatcaaatcaatcgttggactgttaaagtagccgatacttgcatcgtgggttgaaaatccgccaattgccaccgtggcaaaactatgggaaattgcatcaaaaccgttcatacctgccaaccagtaagcaacggcacacagcaccgtcaaagagagataaatcagccacaatgcttttgccgtttctgcaatccgtggacgcattttctgttctttcaacgggccaggcatttccgcacggtataactgcattcccccaatgcctaataacggaataatggctaccgcaagcacgatgatccccattccgccgagccattgtaggaactgacgataaaataaaatcgcttttggcagctgatctagccctgtaattaccgttgcccctgttgttgttaaacctgaaaaagactcaaaaatagactcagagaaattcaaatcagggttttccaacagaataaatggcaccgcccccagcgaccctagcaccacccaaaacagcaccacgattagaaaaccttcacgggaacgtagctcttgcttatattttcgacaaaaccaccacaaagccgtgccgacactgaaattcagcacaaaggcctccaaaaacgcacgaccaccgccgtcatcataaatcaacgccacaaacgctggcacaagcatcgtgaaagaaaaacacatcaccaaaatgccaacaatacgcataattgaaaaaaattgcacagggaaatcctttaaataataagataatgaaatggtactctgctttttgcacgagtcaaatcatttgaaaaccaagatcttggtttataagcggtgagataaattttgcattttacgaagaataaattttactctgtctttgttctaatttttcaatgaccaaattggtttcaccatattcaatttaggcatactcatttgtttacatcactaattttttcgccatatcttctttaaaccattgattaatttctctcatctctcgaattttatcgtgaatttccattgccgttctaaacaatgctggtttatctgcactgactaagccaaataatacggacgagatagttactgtacttaatagcgtaacaatagaaacactatttgccgccaactttccaaacgtttcaaagcgaactgcatatgcttataacgaaaatgtaaatgatgctctaattttacaaaataagatttgttcaattccacgctcttgaattacatattttatctagctgaaataattgtctaagatattgagctactgcctcatctttattttcaccaatttgctcattatttggtaaagcctgttttaaacgaggatctgcattacccattagacagccttttcctgcttgggatagcatttcaatatcattcattccatcgccaaaagcaatacaatctttcaaggtatagcctcgtaacttgactaagtctgcaagtgtatttgctttacaaacgcctttattcatcatttcaaggcattgagaggtagaataagtaatttgtagtaaatcaccataatgatgtcgcacaaattgctcgacaggtaacaagtcttcaggcgtttttccaataaagaacactttttcagtttttttaccgtgatgttgctgaaaatctaccacttgatacataaagccagagtcttggtgatattttcgtaattgttcgatttcaatattaatgaaccatccatcaccttgatagctattaatgaagactcgcttaggatcaaagggtgtttcgctcattatcttaaaagcaatctcttcaggaatatgattttgataaagcaattcgccagaaaggttatttcctcttgctccattagatgtaactagcattgcatcactcacgccaactgtactaataatatgtttaacatcagggtaatttctgcctgtagctagaaaaatatcgacaccacgttgtgaaagtttgtgtaatgtttcgatagtaaaatcgccaatgcggtgatttgcattaagtaatgtgccatcaagatcagaaataattgcacgaaaaggtaaggtcatagaaattcctttatcattttgaaatggtagtttaagcctaacaaatttattttatcatcgcaaaagaaagcatacattttttgtttgtgattaagctacggttaaaaaatagcaaaataatataaaaaatactaaacatcattttttgctgaaaaaaaatgatatttatgcgttatacattacaggggtttatattaatcactagttagtctaaattttttagcatatttaactattttaattacctaaaaatacacagaaaacgtttgcgacaagtataaaatgctgttgacattactccatttgaagttaatatatgttcaatttctgaataacaatgcaaacataaacacacaactatggtaaaacttttaactcttaacctgctgggattcacgcattctgtgcgaggataaggctcggttagagaaaagttcactatccacacttagcccgcacgtcaaaatgcgggcttttttatcgaatacattttaagaggtactttatatgagcaacaacattattatttttgataccactttgcgtgatggcgaacaatcattaaaagcaagtttaacggtaaaagaaaaactgcaaatcgcacttgctcttgaacgtttaggagtagatgtaatggaagttggtttccctgtgtcatctgctggcgattttgaatcggttcaaaccattgctcgccatattaaaaatagtcgagtatgtgctttatctcgtgcggttgataaagatattgatgtcgcagcagaagccttaaaggttgctgaagcatttcgtattcatacatttatagccacttccgctttgcacgttgagtctaaacttcgtaaaacctttgacgatgtattagatatggcagttcacgctgtaaaacgagcaagaggctataccgatgatgtagaattttcttgcgaggatgcaggacgcacaggggtagataatatctgccgtattgttgaagctgcgatcaaagcaggggcaaccacagtcaatattcctgatactgtaggttactgcttaccaatggaatacggaaacatcattgctaatgtgatgaaccgtgtaccaaatgtggataaagcggtgatttctgtccattgccataacgatttaggaatggcaactgcaaactcattaaccgcaattcaaaacggtgcaagacagattgagtgtactatcaacggtatcggtgaacgtgcaggtaacacagcacttgaagaagtggtaatggcaattaaaacccgccaagccttatttaacggcttagatactcgtatcaatactcaagaaattcaccgtgtcagccaaatggtcagccaactttgtaatatgccaattcaaccgaataaagcgattgtggggtcaaacgcatttgctcactcatcaggtatccaccaagacggtatggtcaaaaataaaaatacctatgaaattatgtcgccagaaactatcggtttgaaaaaagagaagctcaatctgaccgctcgttctggtcgcgctgccgtgaaaaaccatatggaagagatgggctatccagagagcgattacgatttagacaaactttatgaagctttcttaaaactagcggataaaaaaggtcaagtttttgattatgatttggaagcacttgcatttattgatatgcaacaaggcgatgaagatcgtttagcccttgatgtatttaccacacaaattattagtggtttgccagcttcagcctttgtgcaagttgagttagatggtaaacgtgtaagccaagtttcacaaggtggtaacggtcctgttgatgcggtttataatgctattttagcgattacaggtatgaaaattaaaatgctcaactataacttaaccgctaaaggcgaaggtgctgaagcattaggacaggttgatattgtcgtagaatatcaaggtcgccgtttccacggagttggtttagcgaccgatattgtagaatcttcagcaagagctttaatccacgcaatcaatgcgatttatcgttcacagaaagtggcggatttgaaggggaaaataaatagtcattttcttaaaaattagcttaagtttatctgtggttgagttaaaatttcgtgatataaaaattttaatatattactgtcattgtataagggaggtcatttttgtttctacttaagaaaaaactttttgaacgcctattgcgttacgttcaaatccacaccacatcagatccgaaaagccaaactgtccctagctcaccgcaacagtgggatttacttcatctactcaaaactgaaatggaaacgatgggattaaccgagatttccgttgatcctaacggctatgtgtttgcaacattgcctgccaatagtgacaaagccattcccgtactcggtttactggctcacgttgatacttcccctgatttcaacggcgagaatgtgaagccacaggttattgagcggtatcaaggcggtgatattttgctaaaaggcagtgggcatacgctatcgccacaggatttcccgaacctaaacggcttagtcggacatacgctcgtgaccaccaacggcacaactttgcttggtgcagatgataaatctgggattgcgattattctgtcagcggtagaatacttgttagcacaccctgaaatcaaacacggtaagatccgtatcggttttactaccgacgaagaaatcgggcgtggagcggatcattttgatgtcaaagcctttggggcagatgttgcctataccttagacggcgggccgcttggggaattacagtacgaaaactttaatgccgatgcggcaactgttacgttctacggacgcagtgttcacccaggcacagccaaaggcaagatgatcaatgccttagagcgagcttgtgagttccaaaacagcctaccgccacatttaacccctgcaaccagcgaagggcgtgaaggctttattatgttgcacgacattgaaggcgatttaagcgaatgtaaaatccactatattttacgcagttttgagcgtgaagaattagcaaaattcggcacttatctcaccgctacaatggcacaaatgcaacaaaaatatggcgaacagtgcggtaaagtagagattgtcgagcaatatcgcaatatgtacgaagtagtcaaagattatcgctatctggtggatattgctgaaaatgtgatgaaagcacagggtattacgccaaacctagagccaattcgtggcggtactgacggctcacgcctatcatatatgggcttaccaacgccaaatatttttacaggcggcgaaaacttccacggacgtttcgagtttatttctgttgatgtaatggaacaggcgacaaatgtggtggtggggattgcaaaagcctttgggggatatccgtttaaatcattatagatattcttataattaaaattatttgtagtaaggatagttacgaataagttatatcttgatcatcatagacctaaaattgaataggcgctaacattgcgcctttcccaaagtaattttttctttatctactaaatatcaaattaggcatagtagacaaaagtgttggtaaaaaagtgggctaaagccttatagtacaaggctttaagcccactttttgaaatatgaacaaaaaactgtcctttttgccttaagaacaatatccaaaagtatggaaagaaaaataatagagatacttttgttcgtcctgtcataaaactttttctttcacaaagaaattaaatccaatagatatttggactgattacacaataggaaaacaaacctataaaaagtcgtttatcatcgtgtcgtaaaaacagaaaagacttctattacaaactcgcattgaacatacttcaagaaaaggctataggattcaatccattacaaatgatgggcgtagagggctgttaaaggatttatttaataccccaatccaaatgtgccacttccatatggtcgccattgtgatgagaaaattaagaaaaaaacatcaatcacaagcgggtaaagaattaaagattattgtaaaaacgctaaaagaaagccacaaaaatgaattttatttgagattacatcaatagtatttaaaacataaagcgtttttagatgaacggtctgaatatcccaatgagaaaggatattttccttataaacaccgtaatgtaagaggggcttatgctagtttaaaatactatatgaaatatttattcacctttgaagaatattctcacttaaatatagaaaaaacaacaaatcggttggaagggttatttaaagaactgaagcagaaattatcggttcataatggattaacgaaaaagcataagattatgtttataaaggattttttaaataaaaagagttggtaataattaggaaaaataattaaaaccaagagcctctcccacaatttgtgtaaatacctgtttctgagataatacattcagacacaggtattttattatgaacgaaaaacaacttcacgccttggcagcggaatttgccaaaaatctaaaaacaccggaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgaaggtgcgaagttctgggcaaatgtgctgacagagcttcaaaatcgaggcttaaaagacatttttattgcctgtgtagacggtttaaaaggcttcctggaagccatcaatgcagtctatcctaaaacgaagattcagctttgcattgtgcatttagtgcgtaacagcttgaaattcgtttcgtggaaagattacaaagccgtcaccgcagatttaaagcaggtttatcaggccccgacggaagcacaggctcgcgaaaatctgaccgcactttcgcaaaaatggcaggcaaaatacccgcttgtggcgaaaggctgggaagataactgggcaaatattgccacattttttgattatccggctgatattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccgttaagttgaaatgggtgtttacacagaatttgggatagggtctccacttggtatagtttttgacgaatcagcaactattttgtctactatgccaattttatttgtactgtttgcaaccttgactatttatttcgctgttttcaggtcttgataatatttctcataaagttcaatcgcatcgcctacatcaacttgccaagggcttttctcaatcacttcagaacgaataaaaacagcaggatcgtcaaccaaatcttttggtaactgtgctaatgccactttatttgctgttggataaccgatagcttttgtcaattttgcagcgacgggagctgaaagcatatagttaatcagcttgtaagctccttccggattttgcgaagttgcaggaattgccaagttatcaatccaaagcggtgtgccttctttaggataaaccatattgattttagcaccttcatttttggcaattcgtacagaaccattccaaagagtaccgatttctacttcaccagaaataaatgagcttgagggattgtcagaattaaacgccaaaatatttggacgtaatttcaaaaattcttcatacgctgcttttaaaatcgcagggtcttgggtattcggatcctgccccatttttaataacgctatattaaatgcctcacgaggatcatctaacaactgtaatttatctttaaactctggtttccgtattgtatgcaatccccgttgccccaaaaagttgtggtaccgagtatttattgcctttatcaaaaggacgatcaagcatttgtgggtcaagctcacttaatacaggcaatttgctatgatctaactctttcaacattccttcacgtgccattttagaaacaaaatagctggtgggggcaattacatcataactttgatggtacatattcagaccatgtatagagataaaccgtattcccttccttcgccatgatgtgatgactaccaaaggtaagagttgccgcagataaaaccactgcccattttttcatattttttgttctccaaatagagagaaatcgtccttttatattgactaaagccatataaaaacttacctaaagatggctatgattttaggttaattgaagctgattgcaacatcttcagtaagatgctgctattctggacttcttatacctactttgcatataatccctcatcatgtaagtataagaaaaaggacgctcgaaagcgtccttatttatctattctttaaaattaaagagcagattttgctttagcaactaatgctgcgaaagccactttgtcaaatactgcgatatcagcaaggatcttacgatcgatttcaacagacgcttttttcaagccgttgatgaatttgctgtatgataaaccgttttgacgagctgccgcattgatacgagcaatccataattgacggaattgacgtttacgttgacgacggtcacggtaagcatattgtgcagctttaactactgcttggaaagcaacgcgatacacgcgtgaacgtgcaccataataacctttagcagccttaagaactttcttatggcgtgctcttgcaataacaccacgttttacacgagccattattaaatctcctactatttaagcgtaaattaacgctttgacattattaaactaaaaattaactaatcgtacgttgtacttaatttacgcttatgcatatggtaagcacgctactactaaaacttggtctgctttcgctaccattgatttgtgacgtaagtgacgtttacgtttagttgttttcttagtcaaaatgtgacgtaagtgagattgtttacgtttgaaaccgccagaagccgtttttttgaaacgcttcgcagcaccacgtactgttttaattttaggcattgttaaaataactccgcattgtttatgaataaccagtaattaggcgaatattgttgccaatattacttggaagcactaattacatctcaaggtaatggactatttctttttaggcgctagtaccattacaacttggcgaccttcgagtttgcctggggcagactctactacggcaatttccgctaaatcgtttttaacacgttctagcacgtccataccaatttcttggtgagccatttcacgtccacggaagcgaaccgtgattttggctttgtcgccatcttccaaaaagcgaatcaggctgcgtagttttacctgatagtcgccttcgtctgtacctggacggaatttaatttccttcacttgtacaactttctgttttttcttctgctcttttgcagctttctctttctcgtagatgaacttaccgtagttcataatacggcaaactggtggttcagcatttgggctaatttcaactaagtctaactcagcttcgtcagctttcgctaatgcttcttgaattgatacgataccaagttggtcgccgttttgatcggttaagcgaacttctttcacgcggatttcttcgttaagacgatgtgcgcgatttgtctgaacacgttttacaggtttaatagtactattcctctagtaagtttaagctacgatcataccgcttgcagaagatatgatttctttttataggctcttctaaagagagcaaaacgggcgagattctacagaaattcatttgattatgcaatagtcaaaatcatttcattacattctcagcaaaattgttgatattccattataataagcactatcttaattacttaaattaataacaataatgaaaattctcggtattgaaacttcttgcgatgaaaccggtgtggcaatttatgatgaagacaagggattagtcgcaaaccaactttacagccaaattgaaatgcacgctgactacggtggcgttgtgccagagctggcctctcgtgatcatatccgtaaaacattgccactcattcaagaagcattaaaagaagctaatctcaccgcttctgacattgatggcgttgcttatacggcaggccctgggcttgttggggcgttattggttggctcaaccattgcacgatctttagcttatgcgtggaatgtgccagctttaggcgttcaccatatggaagggcatttgctcgcaccaatgttagaagaaaacgcccctgagtttccttttgtcgccttacttgtttcggggggacacactcagctagtcgatgtaaaaaatgtgggtgaatatgaattgttgggggaatctattgatgatgctgcgggggaagcctttgataaaactgcaaaattgctcggtttagattacccagggggggcagcgttagctaaacttgctgaaagtggcacgccaaatcgttttacctttccacgtccaatgacggaccgcccaggcttagatttcagcttttcgggcttgaaaacctttgcggcaaatacgattaatgcgaatttgaatgagaaaggtgaattagagcaacagacccgttgcgatattgcctatgcgttccaacaagcagtgattgaaacattgattatcaaatgccgtagagcgttgcaacaaacgggctataaacgtttagtgatcgcaggcggtgtgagtgcaaataaacaacttcgtcacgatttatccgaattaatgaagcagatcggcggtgaagtcttttaccctcgcccacaattttgtaccgataatggtgcaatgattgcctatgcaggtttcttgcgtttaaaaaatggcgaacagacggatttatccgtgagtgtcaaaccacgttggccgatggttgaactttgtcccatcgatgtatagtagacaaagtattataaagggtagattaagatattgtaatataaggctttgagccacttttttgaattatcaggactattcaaagtatctcgaaagcccctaaaatagcattaaatccactactatcacgttatttaaatattattgtggatacgaccttctttgatcgtgaacttggtattttagtcctgatggatttactttctaaaaaaatggtttgccattgagttatcaaaacataaaaagatgtttattacaggatagcgttcaattttgtctattatgcctttattgattcgctctagaaaaagccgccgcttccgcgattaatgcatcacttggacgaatccccgtataaagcacaaattgctcaaatgcttgtaatgtcatcacttctgcaccagaaatcacctgtttgccttgagctttcgcatactgaatcaaaggtgtttcggctggcattgccaccacatcaaaagccgtttgagcctgttgaatcatcatttcggggaaggctaagtcaaactcttcttttccgcccttcataccaatcggagtgacattgactaaaatgtccgcctgttgattttcaagactattgatatattgatagccgtaaagttctgcgagatattttcctgtgtcttgattacgagcatagactttcaaattcgtaaaacctgaatgtttaaatgctgcaacaacggcttttgccataccgccactgccttgcacaatcacacaagcggttggatcgagctgatattttgcaattaatttctcaatcgcaatatagtcggtgttataggctttcaaatagccattggtattgacaatcgtattgaccgattcaatcgcttttgcagatgcatcaatttcatctaaaaatggcatacaggcttctttaaacggcatagacaccgcacaaccccgaatacctaaggctctcacgcctttgactgcgtgttcaatatctttggtggtaaatgctttataaacaaagtttaaaccgagtttttgataaagatagttatggaaataagtgccagtattgcctggtctgcccgatagggacatacaaagttgagtatctttattgatcataaatttgccttattgaatagaataataagtgccattatgctgttttagatgtaaaacaacaaggaagtcgtgaaaaaacaaaagccttgggtttccccaaggctttctttttgcattaacgcataagcgaaaattattcgccaagacgctctttgatacgtgcagatttacctgaacgctcacgtaagtagtaaagtttcgctttacgtaccgcacctttacgtttaacagcaatgctgtcaattacaggtgagtgagtttggaatacacgctcaacgcctacgccgtttgaaactttgcgtaaggtgaatgctgagtgcaagccacggttacgaattgcaataaccacgccttcgaacgcttgcaaacgttttttactaccttctactacccataccttaacttctaatgtgtcacctggacggaagctaggtacgttttgttttaactgttcttgttcgatttgtttgatgatgttactcattttaataaaccttctatgtcctagaattaactgatttgtgttgcttctttatgttattcaacaacacgcgttgttcgtcagtcagagctaggctatccaatagctcagggcgtcttaaccacgttcgctcaagcgactgttctaatcgccatttgcgaatttgctcgtggtgacccgacatcagcacttgcggtacaggtaagccatctaatacttcagggcgagtataatgcgggcaatccaataaaccttctgcgaaagagtcttccaatgctgaagcctgtttgcctaataccccagggataaatcgtgcaacagcgtcaattaacgtcattgcaggaagttccccccctgtgagaacgtaatcaccgattgaccattcttcatctatttcagtttggattaatcgctcgtcaatgccttcataacgcccacaaaccaaaatcaatttttgatttatcgccagagtttgtacaccagcttgatcgagtttacgcccttgcggagagagataaatcactttagcttctacaccgtcttccttacaagcggttgcttttgcttcacgaattgcatcacgaagcggttgcaccatcatcaacatacctggcccaccaccataagggcggtcgtctaccgttttatgtttgtcgtgtgtgaaatctcggggattccaacactgcacttgtaagagattttgttttactgctctacctgttaccccaaaatcagtaattgctttaaacatttcggggaaaagggaaataataccaatccacatattttgacctacgaaatgcgactgctaaagctcactgcatacctgaggttagaaaccagcgtcccaatccactgtaattgttttagtggcgagatctactcttttaactacttgttcatataagaacgggattaaacgttcttgcttaccgaaagcatctttactgccagcttttaccaccaacacatcatttgaacctgtttccatcatttcggtcacagttcccattgcataaccttcaaggtttagcacttggcaaccgatcaaatcgtgccaataataatccccttctttcaattctggaaacacggctaaatccacaccgatctcggcgttggttaatagctgtgcggtttcgcggtcttctgtgccttttaatttcacaatcaaatcattgttgtgataacgccaactttcgagttcaacttgttgccattgccctttaatttttaagaaccacggctgataatcgaaaatgctttcaggatattctgtcgatgaataaaggcgtagccagccacggataccataggttgaacctaattttccgacaacttcaattttttgctcgctcatactcacctacttatttaatttgtggaattaagctgctttacgcgcttctttcactaatactgcaacacgatcagaaagtgatgcacctttagcaacccaagcatcaactttagcaacgtctaaacgtaaacgttctgcgttaccagttgcgatagggttgaagaaaccgatacgctcgatgaaacgaccgtcgcgtgggctacggctgtcagcgacaacgatttgatagaatgggcgttttttagctccgccacgagataaacgaatggttaccataaccgtcctctaaaagtttaatgatagtaaaaaagaaaaccctcgttcgaggtgagggtgcgaaacttgttcaaaaaagagagaacaagcggtcggattatacggattttttgcaaaaaggcaagtgaaaacccttgttttatgtttacaactctagaagaaaatgcaaaacaaaaacctattctcacgacaattattttcattctgtgataggaatgatggatatgaacttatcactttcaacctataataaagaattagatattttgaatcagtgtcgtaaataatcctatcttgttatcttaaacgttatttaaaaagtagcttagttataaaactaagctactttctcaaatactcaaccctcacatttaaactcgctaataaaatcgcaataagcggaattacataattcattacggcgtaaggggcatattcaaatgcactaacttgtagcatagagaatgcataaataccgcaagtattccacggcactaatacggaagtcactgtaccgccatcttcaattgcacgagatagattttttgaacttaagcctttttcacggtaagcatttgcgtacatccgtccaggaagcagaatagaaatatattgttcagcggcagtgcaattagtcaaaatagaggaaagaacagtagcaataataagatgggttgttttgtgggcaatacgaagaatagtttcaacaatggacttcagcattcccgttctctccgcaataccgccaaatgccattgcaataatggtcagtgagatggtgaaccccattgcttcaatgccccctcgattgaataatgagtcaatcattgcattgccactttctattttatagccataatgtagcgtgttcaccgcgacttttatctcgccaccttgtaccacaatatgacaaagccagccaaacaaaatcccgatagttaaagcggggagtgtaggcactttttttgcaactaaaacagcaacaacgagtggcacagttaatagccacggtgaaataacaaagtgcgttttaatggcttgcataatttcggcaattttttcgagttcgacactttgagcattgaactgtaaaccgagataagcataaacaagaagagcaataaggaacgctgggagggtagtgatatacatatagcgaatatgttcaaaaagcggcgtgtgcgtaatgcctgcggcgagattgatagtatctgaaagcggggacatcttatcgccaaaatacgcccccgaaatgaccgcacctgcaaccatcggagcggggatattgagacttagcccaatacccattgccgcaacaccgatagttcccattgtggaccacgaactgccaatcgcaagggtcactaccgcacaaataaggcaaattgtcgctaaaaatagagagggcgagatgagttgcaatccatagtagatcatcgtggcaacaatccctccaccaatccacgcacctatcgttaaaccaatcataatgatgataacgatagctggcagagaaatacgaatcccttgatatattccttgttctatcgtatgccagcgatacccaaaacagcgagcaacgatagccgcgataattgtgctaatcagtaaaggaatatggggagatgattcaaattgaatgacagcaattcccattgataccatcatcacaatgataggtaaacaggcatagccaaatggaatgtgaatttgtggttcggttgtgtgtgacataacttcctcaaacaagcggtaagaaatacagagtaatttgcttttcggtagctttcactaataggaaattttcatcgaagcgatgagagattaatttacaaggggaaattcgacagagaggggagttgtggatttattcgggagctattctaacatatttgattaatatttcattatataaaataaaaaatacctgtatctcgttttagatacaggtattttttacatctcaacttaacgcttatttacgttgagttaccacttgaatgaacggagtttgtccttttttcatctgttcattcgcttgtttaaccatctcttctacattggtatgtaaatgagcggtaactttggtgtttgcttttttctctggaaccaagcgtgctttcactgtcttaccgtttacaacaaggttattttgttttgcattcacattaactggtgtgtttgtcgtttcacgtttaatgtctgcgtttaacttcacatcagctttcacacctgcaatagaaccgttattccagtcttgagctagattgttgttccatttttgttctgggtaaggagtatatttaccgctgccacttgctaaaaccgcacgacataaccgcaaccccaaaagcgagataatttcttattctcgctttttcatttaatgaaataatattacacttttgcccaccccagccgtccacacctccccagtctaaatacaccgcactcagttgtttttactcaaactaaacttgccatgcagggctaacagagtaatcctgtcgtcacttaagcaaaacaggagagcctaaaatgacaaccttcaaaatgagaactgagcaagaaatgatgttagagttagccttagttgcggtaagagaagaacaacgttttaccattgacggatcgcaatatacctgaccaaacggacggggacaaacctttgtgtataaccttgcattcttagatattcgttttattgaagatggtcgcaaagatagcgttgtacaatttacatcaacccttgccccatcagcaccgccgttttattgtttattatctgaattagattaaatttaaacgccctttaaactaattttaaagggcgttatttttagaacttatacaccatattatcttcatacttgcctgaatagctcgtcgaagtatttacaacaatacgctcgtagtcttggaacgcctgccagttatcccatttatcttcaatcatagcgtccacataacgcacaaactcgcttttggttgaactgaagaacacaaaaggcggtctggttagatgaattaaccgcaagaaatccactaaatcaaaataagttgcctgtttgtaacttgcctgatgagtgcaaagatatggtgggtctaacacaaacaacgctttcgggtcattttgatattttggcagtaacgtgtaaaaactttcgctaaccacttcaatatcgtctaaatatccgtccgcacttgagtaatccgattggcgaatgcaatgccaaaaatcttctttgaacagctcgtctagtgttgcaacttgctgaccactgaaacataaccacgaacataagatatgttcattgatatagccgtcaaagtttttaattacctcaatgatttgggcttttacgtcattcggtactttcttccgtttttcacaagcagcaagcaatggataaataagtcggcgtaagcggttaatatcatcaatatgtgccaatcgctctgcgtaaccatcgaagtcgttataaataaccgttgctttgggttttaaccgcttggttacgtggctaagcaaaccactgcctccaaacacatctacaatcgtccagccttcgccatcatttgggatattctcaagtagtttcccaaaatgctgtaaaaacattcttttttgcccaataaatggtagcggagcctgtttaaagtaggctacacttttgcttgcttgcttgcttgcttgcttgcttgcttgcttgcttgccggtattttgctctttttccattatcgcaacatctcctttttatttaaaatcacagccaactgattcggactaaatcgccagccctgctcactattaaacatcgcattaaagcaccattcagagcaaaagaaccgttctccacgttgcttaaatccaagcactacacccaacgctccccaaaggtcatatttcttgcctttggtctgctcaaaataggctttcacttgtgcttctgtcacatttggtagctcaaccaaatcccacttagagcggtcagatacgttgataattttgcaacgcacaccaccatcacgagggcttgagctataacactcaaaccactcttcttgatgataatggtcgaaaattcgacttttatgtattgcaatctcacaatgcgagtattgccctttggttgctttgcgaatcagccaatcttccaaacgggcttgccagtttttggcattgcctttgtaaagtgcaaggtagattttattcattcgctgctcctgcaaattcctcataagtctgcgtccacccatccgaataatcatattcaagcggattttctacttgctccaccatcgccttatgcttcaaggcattagcgtgattgccagtcttggcttccattaacacctgccaaataaccagtagcttctctttgttaatcattgccaccgaattatcggcgaacgtccacggaatttcttggtcgccgaataaatcaaacgtcgctttgacagacaagatattgcgttcggcggtggcatcggtatcaatccatttgtcaatcgctggcacataaacaccgccgttgatttttttgtctcgtagggtgttgatggcgtcacgaattttctggcgttgttcttcaataggtatcggcggtggctcacttaaaatcggattcccttcatcatcggcaataattagcttgccttgagcttgcccttcaagtaacaagcggtagctttctgccgaaatttcacaagcgccctctggtacaaagccgccgtggctgtcgtcataaaagccgtttttgtaataaagtgtcattgtattctcctatttccagcgaccaacacctaaaaattgcactcgacagtcaccttgattctcactgttgtgttcatataatttataataacaaacagcattggtgctttttctcataatagcactaccaacatcgctgtttataccataggtatgctccactttaggtatcaccataggtttatcagcaaaagcgacagcccaagtaaattgcttttctccccattctttcaaatcatttacatcataaaaataggtttgaatcatcatcccatcagggtatttgcgaatttcaaaattgccgattttttgatagataaaatcactgagattggccagctcaatggtattcccccaagcattaagattatttgcagtttggaagcgtattctatcgcccgaaataccaatacgattgcaagcaaatactcctgagttatctggcgagcctttgttaatcatcatccagccatcgcccgcaccattcaagtgagattttttagatagccccacgaaagctccaagcggtaactgcgcaggcgtagcatcttggaaagatatttgcccattagcaatagaacgcaaatcaatctgtcgaacgggaagcaaatttccttcgtcaaacacgaggtgattgcctcgatagataggtttgttcgattcaactctgtcggacttgaggtgtatacctgtgttatactggtaggataccagtgcaacatcgttatcattatttctgactcgtccaacaaaccagtcatcaacgccgttgttctttcctctgagatacgaactcgcgtggttaatattcaatggacctgtcattgtgtccccagctttggcaacatagttttgacgggcactattaagcgcttcttcggttaaatcttcgggcgctggagcccaagtcatagctctattgccttcgacaagcataggattttgtaattctacaagtccttcacctggattaatgaatgaaatgtttcttatcgcactaacaaaggtaatcgatattttttgccatatgcctggagtcaaatttcttgcatgaaaattaacccatttctgcccatcgtatagatggagataaaacgcagttctttcgggtttgacctcagcactaaatgtatattgcttctcaggcaaatcaaaagtttgtctccagcaccattggctcgatgtatctaaactttttaaaactgcgattccatttctaacatcccttccaccaattacattccagtgggtagtgtcgtttaatagacgagaatttttaattaaattccgcccccccaatctcaatcccatcaatctcatcttttaagatttttccctgtgctgccgtcaacgcctttgtggcatcattggtggttaagttattggcgagttgcaccaagcccttttgggttgggctggcatcttgagccgtgtatttactattagctaaatcataagccgttttgaccgcttgtgacgatgccactgtagtttgagatgttgaattgacagcgttactgatatccgttttattgactttttgatttagtgcattattagtattaacctgcaactgtgccacagactgagcaatagctttacctgcttttgcggtaagtgctaatacctcgctgtcaagccctgtgtcgttggtgagttgaacaagtcctttggttgtggtacttgcgagatcaatctcgtgagtatgccctgtactgtcagcggtgttgcgagtggttgctgtcagttttttaggtatcagtttttgtcctgcagcttcaaggacttgttttaaatataaggtacgattagcaagatgcttaaggggcttgttagtcactcctttcacaccaccaagcacaggatcgtcttcctcaatttgatagacttctctttcccatttcgctatttcgtttaagcctgccatttctatttttgtcctttgttgaattaatttgaaccgtggttatatttgccgttataacgagccttactgttatacctgatcggtacagatttataatcaagtactgccaataaacatcttgcgggagcaaaatttctcaaaaccttacgaatgtttactgcttgatcattagtgacaggttctcttaagcgaatagcataatgagcccaacgttcatctgctggtatattgacgacattagaattttcataaattctgtccttgagcccttcatctatttcaatttccccaaaacctagcgaacgtaatacatctcgaattgccttaggtgtgccttttctacgatgtaattcaatcgcattgcgaattagagcctgcttagagtcgttatcttctgcaataaattcaccgtcatagcctgtgacactccatttctctgccaacagtggaataaattcatcacctaataattccacaatcgttgtcataatttgagcgtggtttaaatgatctaactgattgctcaaatttgctaaagccacatatttagggtcatttacaatgatgtcggggtacactaacttagccattactgcgttcctcttttacttcgattcgcaatgcagtacagtttgcccattcattttcagcaatgattgtttttgtcggtgaaattaaattcacatcatatacgccatcaacacgcaataccgaaataatggcactcggtacaatatccataccgagctttttagttttatctgaaagatataactgcattgcatcacgagccttggttttcacaatatcttcacgataaccatcaagtaaaatcaattctgcttgaatttgataatctcgtttggtcggcgcaatcacttcaacggtatcgcacaatgggcgtagtttctctgcactaacatattttttaatgtcgtttaataaacgtgtatcgggtaagcctgttttagttaataccgtgatacgaacaagcccacctttaggggtggcaatattgacatcggcaatatcttgcgacaccgctctaacatggtagtcataagcagcaatagagccacaagaactaaatgcttcaggtgctgcaagaatccgcttgcggtagtcatcgtcgttttcttcaactaaaccaccactaggtctatcaatattagtgacttcaagtgtggcggtcgtattaagtgatgttctgagatttttaatccgaccaatttcccattcattaccaatcagccctttcttattacattctgcttcaatttcaacgtaagaaatcaaaggtgtaatcacatcatcatttagcgtaataaaatacagatcatcagtaatagcaacttgagtccctttaggaattaaaatagacgagtgttcaccttgtacactaaatcgcagaacacaacgagccgatttgtcttttaagcgatgacaacctaatgtttcaccacacaaatccaacgcaatccccgttgccgtttgcggaaaggtttgacgaaatgcttcgttaatccctttacgcaccaacatttcacgaaaggcataaacgttgataatcaagcgttcaatatgagcaggttgtaataccttgcctgtatcttgttcatattttgcgatagtctcggcaagaatctgtttaacatcttcaggcacaacggtaatgtcataacgactatttatttccataatcaaactccgttgcataaatttgacgttcaatatcttcagcaacacaccatttcacattaaagaaaaaatgcggtgcttcaccactaatttgcacttcttgtactaccacgcgtttttcccatttatcaatcgccacaaaaatttcccgaaccatatttggtacagcaatatcgaagggctgatcaatatattcaaaatgatttgagccaaaatcagggcgcaatacatcgcttcctttacgagtagaaaggatgttaataatgcactggtgtaaatcaccttccccctgaatgctctcaacgccttcaggggcaatttgccaatgtgtatgttgaagtgtatgtgtattcatagccgtgagtgtaacggctatgatgaagatgggcttttaaactactttaaagattgactaggctttgggtgtacctgatgttttattaccactttccaccccagtatgaacgtgagaacccagagaaacagagccttgttttacacttggtgcagaaacttcggtcgcagaggtaatagcacctgtggcgtgcaaactgccattgataactgtatcaccgttgatttcagtcggagcattcaccaccgcttgagctgcggtgacggtgactgtaccactggttttgactatcacatcgcctgttttacgattgtgggaaatttccgtgccatttttgaatttatgtaaccacatttcactatctgtaacaggtgttggatcttcactattataaatcgacccaagcacatacccaccttcaccccttgcatctaaaatcattgccaccaactcgcccacatcgggcaaaccgtaaaactgattaccgcctgcattgatagtaaaaaatggcaaccacgctgtttcaaaatcttctagcgttgggattttgactttgacacggtgatttttcggatcgacttgactgacaaaaccttcttgataggttgccccaaagttatgggtaacgacagctttcttcatttgcaaaattcctgttaaatcagaccgcttgcggtcggtaaatcttcaataaattccaacattcgaacatcaagatcagtcacatatccctgactttttgtgtaactatgacgagcggatttaatcaagtatttgccactaaacataccaaaacctgtcaataacaccgtattacctgcgactaacttaggattgccaatcacctgaatattgcctgcctgttggtcatcattctgttcagcaagagctgcatctgcacgagcttttatctgctcttgactttcaccacgagtcacaattttcagggtgtcagcattactggctttagattgctttttcgtagggcgtttaggcttactgcttttttcggatttcaccgtttttttactatcggcattcagtcctaccgcttcaaccttctgcaccgcatctttaatacgatctcgaagccgtagcgacagcacttgtgaaaaatccaataccgtcacaggtggacgattttcaaggctctccattgtggtgaacactaaggttttacccacaatcttaaaactgtgatggtattcgtgggcaaggcgagttaaaaactctacatctcgttcttgatactgagtgacccgttttattgggatattggcgactgttcctgtaacatcgagtttcaaattttttgctacttttcgcacaatgtccgcaagggtagtattctcataggctcttggttttaatgtacgattagatttactaatccctgtcgccaaggctcgtagagtcaccaccgaaccactgcctttgacttttgaccaatcaatttcgtctaactcaaatgaacctaaattgactaatgactcacccaaataccctaaatgcaatttcagttcatcgccttgggtcggaaaccaagagccaatccatttctgctcaatatcttcaaaggtgacttgtagctcatcagattggtcacttaaataatccgtataagttagactaatcaaatggggcttgatgttatgtgtaatgaccgttttgccgtaaaacagctcaaaggtgggcgtttgtacttgcattgcttactcctgcatccaaggcggaagatctgcctgcgacgtggctttaaccgcaatcacaggcacaaacaacgtctgtcccatcggtaacacttcacaaaacggaatatggggattagcatcgattaaacggcttatttcacccacatcaccgtaatagcgataagccagcaaatcccaacgttcgcctgccttaatttgatgttcaattacgctactcatcaacattctccttcggctcaggtgtatcactgcgtaaagcaatccaagcggttagatgtgctgtaggttttgccattgattgagcaatttcatcggcttcatcaattgccttcacacccagatcaaaccacgcacccaaattattctgccccaaaccacgaccaaattcagtttgagcggtacgcaaggtctcactcagttccaccaaaccatttaaaaacggcatagcccctgttatcccttgtgtaagaatgccaaagctatgaccaagccccaccatctcagccaaaccttgagtagatgctcctaagctacccaataaagtcggcagttgtgttaaggcttctaaagggttatgagccaaagcacgcacaacggctaccgtattgcggacatcatcaatcgtctgccgtgcgtggcgatacacttgcacccctttattgactaactgagccgttttactgacaaattgggttaggtctttcggcaaaattgaagcaaggggagataatccaccaatcgacaacgcagaacccaacaagccctgactggtattaccaacaaattcacgcaagctcacagacacttcacgggcaagggcattgcctttagcatcactgaataagacagaactactcaaatctgtaatcacaaaatgccccttaaaccgtgaaaaacctaacacaagggctagggcttcctgtttctcttttgcagtaactaacgcttgatagcgttgttccacaggggcaagctgatgatgtaacttcagttgcaaggtaatatcggtaagattatcgcccattgcctgcagtttcggcttacctgataacacagcgtgttctgcaaaggttgccgaacgacgttcatcaaaggctgaaggggcagttaataaatcaaaggcaatattgccaagtaatgcgtaatttgccattagtaagctctccgtccaaattggtcgtttactcgattaagcagttgctccaaaccgtataacattgcagggtcatttaacgcttgcaataactgttcttttaaatcaggggcaggggctgaacctgagatcgtgatattagggctaaaatgcaccgtaatcccttgattatgggttgttgctgtattggagacttcatttctgtttaagggttgataatccgcaaacaaaccgccgtcttttgcttggggattaaaggacggcgtgcgtaaatccgtaggttgatttaagcccaatagattgccgaccatattcgccccgaattgaatatcgtcccataaactaccaaagaagcctttttccttgattaaggttggtttaaatatcgtttcaaccgtatttaaaacaggttcaaatgtcactgcatttgaaagatgttgactggcttcagtcgcaaggggttgagccttatccataccaatcactaagccttccactacattgacaccgtagcctttaaatacacggctaggggaatggatccctaatttttcggcaaaccaacctttaatgccactacctaattcactgactttttctttggctaaattccacgcattgctgataccaccaacaagcccgtcaataatatttttaccaaaattgctaaactgcatcggtaaatcaatgctaaaccaagacagcactgttgagaatgcagtctggaagagtgccaatggattaaaattcaggattgtctgacctattgtgctaataaattgggttactgaagttgataatgttgtccataaattactaaagaatgtagtcacagaaccccaagcggttgagatcaaattggcgacggttgaaatagcattaccaataaatacccccacagcttccccaacgcttcttgccccaccttctgcaacttgttcaagtgaaaataagttgcggaaaaagtctaaaacaggcgaaacaatcggacttaagccattccaaatagatgaaaaagccgaacctatactttcaatcgttggttttaaaggggctagaccttgcgatacaccatcaataaaaccactaaagaaggctttaaggggttgccaaaatttatagataactaagccacctacggcgattgcagaaatcaccgcgcctacagggctaaatagcattgctcttcctgcggttatcaccgttttagcaaaggatttatatccgccagcggcaaatgctgtggcaagttgtgttttccccaaccctttgactattttgtcaaatacggttgctttaccatttagtttgtctaactcggcaagcgcttttgttgccttaaaaagacggattggcatcaacatacctgatgcaacagtcgctaatccactgaaggcaaatttggcaatataaatacccgtactcagtgtggtcatacccgcggcaagtccaattgcccatttgaccaattgtttatttttctcaagccaaggcgtaaggctattttcaataaagtcctgcgcgatactggcaaactgtttaatatcatcggcaaaggcagatccaaatgtgccgacagcactatcccaaacaccgccaagagcttccaaagcagcaccaagagttttcgttttttttcagcaatacgatcttgtaaacttgcttgctcacgcatcttggtgagcatttcctctaaaccttttttcccttttttagccaaaatatctgcaagacgaccgccttcgataccgaacaactcttctgcaactaaaccaacaccttcatcaccaaatttagctcgaattttctcgaacttttccatttcagtgagcattgcatcaatgcctttaaacttgccttttttatcccagaactcaaaactcaccccagccgcttttaccatatcctgagcttcggctttcattcctttggttgcggctcgcatcatcttcggccctttattcatccgagaaagcatcatattaaatcccgtaccaaaggtcgaaccctcaagcccttgaacgcctgccataccttcaatagcaagaattttttctgtgttttctgctccagttaatccgagtgaattgactttcggggcgtagtatttcattgactcatagacttgctcttttcttagccctgaagcaaacatagctcgttgcaaataatcagctgcctttggtaattctttttcacttaacccgtgagactctataaattttgcaagaaattcaccaccggcataatgatctttaatatccaataaaatgtttaattccgcggatgttttaagtgcaccaccgactaaaacatcatcagaaataccttgttttttttagagcctcagcgagttgatagaaatcttttctcgttcccggcagatcttttcctaattcacccgcaattttgcctatttcattgaatttaccgatagtcccatcggctttcatcattgcaattttaagattattggctgactcttcttgttcaataaatgtttttaccgatgaccaaacaggcattgccactgcagcggttgccgcagtggaattaaaaattttgcctttcagttcatctctatgggctttgcgctgttcttgtcgttcaactgcttttgagagtgtttgttgtgcggcttccgagcgcttaatagctttagtaaaaagctgttgtttttcaacggctttactaatgctggcttgcactttctcataacggcgcaccaacttggcaacattttcatcacctgttaggtaggccttggatattttctgttgtaaagcaatttgtttttcttgcgacttggcaatttttgagcttaatttttcttgagtttgcatagccttgcccaaaccattacccagttcatcaatggtttttcgcgctttgccaaatgctgcaataaagctacctttaagggcagccccaataaccaaaccaattgctaattcatttgccatttaagttatcctgtgataaaaatagaacacattgagagaggagattagaaatgaaactgcgtaatatgactggcgaatcaaacattactgaaacagtccaacgtgtcgttatggtagtttcactgatttgcttcgccatctggttggcagccgacttttatagtgggctttgggggaattggtcgttaaatcaattcatcattacgacattttttacctgattgtcttagtgattggggcatttgctgtcgttttagcgagcggttttataggtctgatcatcggtggactactcgaattactgaccacaatcacacgttataaaacccgagcatagcctgctttaacttgccttttcatctgttcaacccatttgggaatatcgactaaatccatctccattaaatcgcttggtgaccaaccaaaccaccaagcgagatccgcaaaaacttcacttaattcactggttttttgggctttccctcagtaaccaattcaataatcagggtagatagcgcattaaaatctgccgcatcaagctcatcaatgtcttcatatacccaattcgacaggcggtttaaataaaagcgcaccattttgtagtcgtctgtttccggattgaaattcttattttcaaaagcttctaaatctgagcctttgatacggcgtaggttgatttcattcagtacttcaccatccggcttagtgattggatatttcaatttgtgagtggtataaacacgcaaatttttaagtgtagtcactgcttcatttgatttgggcataaaaaactccttagtggtattgtttaacttcactaaggagtttacggtttttggctacgggttgattttaaactactttaaagatttactgcccgatgttagtgcggtatttctgtaaaatatcttgccctgcaacattatatttgttgctataggcatcgtagtacagcacttctttgccatcaatcacttgcttgatgttattgatttggtaagtcatcgcatattcggtcggctcttttttatattcgcccacgttcactttactgaatgccaccgtcattgtcatcacaagcggcacttcggttgccatacctattgagttaaacgcttgtacattggcacgcaccattaactggtgtgctttaaatggattgtaagccaaagcaaccacttccagataaaagccgtcccaaacaatttccccttccaacgcattgactttattcggcagtttcaatttgccaattaagccaaggttatcgtgctcagcaaactccacttcaaactccggtgttttaatggattttgctcgacctaaaaagctattgccgttgatatagacattggcatttgccacttggttaatgaccacactcattaattacctccacgactggttaaattaattaagaactcacgagtgacttcggacgtattcgtgatgcgttccgctgggatttttggcgtgaacttatatttaatcggcacattgcctttactaaaggcatcaaccaaatccgcatcaggatcaagccagacttcaaaaccaacaatagaacgcaatgtacccatataggtttcaatcgtgcctagcaatgcatctagcaaagcatcatcaatcggcaagtcaataaattgcaactctacacgacgaagagattcatcaattaagtctgcggtacgttgtaccacttcaaaattgacaatatgggtttccgttgggtaattcgctaagcggttaccccacaagcggaagcctgtaccatagctgttaaataccgtcgtaatacccactgcgttcaagcggttggtttctgattgaatatcatcaacacgagcggtcagcggaatttccactccaatcacaccttttaattgacggttagacgttgagaaccaatagccaaaatcaacgtccgttcgcatacgcaaacctgcagcgtgggtcgcaaggctttcaagagtattacgctctcccacaacgtgtgggaagaataaatgtgtacggtcacttgaagtcttgaagttaatttgcccttccgtgccacgtcctgctaaggcttttgcaagggttgtgccttgtggagcttggatataagcaatcgcattgagttggcttgctagggtttctagtgccgttgccattgttgcttgagtgtcgtagtgtgggcagagtaaaatcttggcatcactaccaaacaagttaaaaccagcacgcaacatttcaaagcctgtacgtttgcctgtgcctgtatcaatcgcacctttaatatccgcttccgtgactttagttgggtctgcataggtataagtcgcagtcacattttctaacatacgatgaaacttgatttcacctgtcaataaatcggcggtgtaatcttgcccacttgtcagcgagcctgaactatgactaagacttaattcaatcactccagcgtatgctaaggttgcggttaggcggtctttatctaaggttaaattttcacttgaaaccgtcgtgcggtgtttggctgggtctaacacattgaccacataaacttgccctgcttgataacggctaataatatctaaggcatctggcaaggtatagccacgatctaacacattgccgaattgtgcaaaatcctttttggtcatacacaatttcagctcattcactgcaccaacaggggcagtgccgatgatgccgataatagcaccatcgacggtatgaacaggcacagaaccgcctttaactcgtttggtttctgtaccgtgatggaattgagacataatattctcctatgatttgggttttaaacgggcatcaaggggctgatgctcttatctagcaataaacgtggtaaatttcggctctaaatcgaccgcttgtagccgttgaatttgcaacgtttctgtggctaaaaccagctggtaaatccacacaccgctatcttgctcatcaaactgttcttcaactaaccagcttggcgtacagtctatcggttgaaagccaactacggaaagccgtaactcatctaaaaactgcaaagcaccaaagtcgttatgcaagttgcgacttaacaccgtaaagacaatatgcaccttgcgagtttgcgtaattaccgacgtagagcgtggctcgctaaattttgacccagcataactaatcaagaccgcaccgtttgggtgcgacagaaaatagtggctagggtcatcaggcattagctgaatatcccaatcgggaaactgcgttttcaagcgagtttcaaactcggtcaaaatcggcaaggtggcagacattagtaaccccctgtgtctatttgttgtttggctcgcaccgcatattcgcccacgtcaggcaataaatcgcctgtttcactcacatcttctgcattggctaaaccaagatgtaacgtacctttagcaatggcatctagctctttaatcacttgagcgtaggtgtccttcaccgtttcaggcattttcatttctgcacggcgagtgtaaagccagtgacgagcaaggtacaaggcgtgcgagttaatcattgttggcacttgagtaaggggtaaggcataacggctacgcagtgacgcatcaatacgttcacaagccgtttgaattgcctgttccaccacagccatattcacgtccgtcgctctgtggtcgtcattactgagctgaactaagatctgcttactaaaagagccaattaactcatcagcggtgatgtacattattttttgccttttctttagtcgctttttccgtagcttccgcttctttagcatctaactcatcggcaatagcggtagcttcagcttgtacttttgtagcttcatcagcctttgctgtatcttccaccttagtggtttctacgttgttttcttcagctttactatctattaattcaaggtaataagctaaacccttagcttcctgttcggtcagctcaatatcatcacctacttcataacgtttaccgttatgtaacaatgcagtatgttttactttggctttcattgtttgtttccctatgtgtaatggtatttcagagtatgatggggaaattccccatcacttaggctgagatacattttgaaattaagtagcctgcagaagcccctactaaatgtggtttgtgaatatcggtggtacgaactacttcaatcttgccaccgttttctttatatgtatcgacaaataaacccttgttacggcggacggtgtagccataagatggctcataaactgtacctttaccttgtgctgagcgtggggcaacataagctaaaacaaccgcatcagaccaaatgtctttgagttggctttcgtgctcgtagactgcttcaccaattttgacggtatcaataccaatcaatttcgcaaacacttcaggtgtcacgatagcaacttgtgaatatttcaatttttcaattacttttggatgctctttaagtgcagcccaaacatcacctgcaatcacacaaacatttggcttacgcccaatagagcgtttaatcgctcgaatacctgtatcaaaaatgccaaaaatatcagcatctttatgggtgaattttgatgtaccacttaatgcaattttgtttgcggtatcgtatttactttcatttaaagcaagcgttgccacttctttctcacgacctaaagcaatcacatcttgcgttgtatttaaggcaaattgacggagagagaaaatcgcttcattttcttcacgatagtcaatggcatattccacatcgtgttcttcgagtgaaacatcaatcgctgtaatatcttcaggatctaagcggttagatgtgccacgcaaactacgcacggtggtaggtaaacggaaagcaaggcgaccaaatttgggaatttttcctgcttctttttcgatctctactgttggcattaaggtttcgccaacaagttcgttgttgtgatagccttgtgcgagttctgttaaaacagggtcttgcacacggagtttttgtaaattatgagtagtcatttcggctccttatttgtaaatagcgttaaatgcttcggtgtaactcacccctttttctttggcgtaagcacgaattttctggtctgcttcaatggaatttggatcagttccttcagcataactgacggtatcaggctcaccgtcataagctctctctttcgtcgccacttcaccaaactgcaccacttgcggttgggtttctaagaactttttggttaagctgtgaatagattccccttcgttaaaattcacgacttgaccgcttgccatcgttgccgaacagttaagcaaggcaagagcagcgtcttttgcaacaggggcaagtttgccttgagtgactaagttttcacaaaaggacgcattgtccgccttggttgcttccagtttttcggcaactttatctgcttcagcttgagctttttcagcttttagctgggcattttcgtcttgcattgctgcaatttcttcgggtgtcattgacatttgacgttctccttcaggtttctttggttcattaaaaatagggttagactcagggacttgataaaagcgtttcatatcttcacgcacagcatcttcttgaatgctggataccaaataatcaggcagggctttatcggcttcttcctgaccgtgcttgccaataatccaatcacgcaaacgtcgccatagagatgcttccgtccagtctgaaaaatccactacaccttcttcgccttcggcaaaatcagggttacgaagtccttttactgcaggtggcatcgcccctaaaaaaccaacgtggcgtaaatagagcgagccttgtttaggattattcggactattggcgagatagaatgaagcagacactttcttaaaccgccctttatccaccatctcggcaaattcaggatcgatttggtcaagttccgctttgagaatatcgccttccagttctagacgttttacccacgcatacgcagggcggttatgttcagggtgaccaatcaccgcaggggcttcgtgaaattccacgttatagctttctacggcttgttttaggtcggcaacagtaatagtgacttctgtgccattggcatctttacgagtgccagctttgaagatttcgattagattcataatgcctccgtttcgataagcattatgaaaaaagagcgtgttttcggcttttaaactagtttaaggaatgcaaaaataaaatagacaagtaagagaagtgtaatatgcgatttaaggcgtttacaggtgtttataaacgccttaaatttgtatcgagctatcatttattgaaaaaagaataaaacgctaaatcgggcgttttaggcgttatttttgaaatttagctatgaccaatcacatttcgtaaaaaatgttcagtttttgccagcaagtagccttcatttttcttacttacgccaagccaagggcgagcaggaatacctgaacctttgccactggctttattactgccaaagtgatgtaagcgagcatacttgcgatcacttccaaaggttacgccttcattagtcgcttgaaagcggagtaaatttctcaaatagccatcgtgaattaaaattttatcggcattctttcgttttttagcctgatattttgccgataatggtgtccacttttctccatcaggtgaagcctgttctttctcaaaacggtctttgtgaattgaacgtaacgtttcacctaataccccaaagagctttttaccctgttgcaagttttgggctgtacggtgtaagcctctgagagcttggtcagcatcgagtttaatatggatcattattgttcctattgattaaaaaatagtttaggcgtatagtttggttatccgcagggggtttcctactggaaaggttacgctaggcaactaccgtatgatcctgttcgaatcaggcaaacctgcggattattctaaattgccccataagacttcatagcctttcaaactttcccattgacgagcattgctaatttttgtgccagttgtcaccatattcagtgcaatccgttcctttttcttcgtaacactgtttttcacctgtactttatagtccattgaaatgattattttggctccatcttcgtcatacacaaataacagtgcattaagtttttgagaactatctaataaaatcgctttcggactacgcaatttttcaggcaactgttgccaaaactcaagcggtaggtttatccctttactttgcttcacatcacgcaaggcgtgcagaatatcgtcatcacgcactgcaatcacggcggtctgtggagcaagctccatcgtttctagttttttcactacatcacggggaataacgccaacatatttcatctgcccacgagccattttatctgcgacaaccgtatccaccatctctttcattgaacggtttaataaggctaacgctggggcataattcaagacattactcaccgcagaactggcaaactgcggtggagcctcaaccagtttctgcattaaaatttcatctaccttatgcacaggcacaaggcgtttggggtgttcaaaactcggatcgacacctttcggtactcgcacaattctcggactgcctgaacgctgtccgatcaccttttcttcccattcaatttcaggggcttgctgaacagttttattttgatatttgagatcgacatcatctaaggcacgcacagtacaatgacaaccgtatgcacgggttggataatggtagtcccaccacggatcatctgctcgtaatactaagccgtcccacgcaacgtgttgcggtcttgggtgagctgagtcattatgctcatattcccaataaggcattacatcagcaagttcacgctgttgcatataacgcccgtggttatagctggcgtaaagattagtgtcataaataatacggctacgccaatttcgcccgccgttatattcccagctatgtttgtcggcaatggcatcgaataccttacgaaactcttctaatgtgccaccacgatcaatcacatcatctatcgcacggcgaaaatcgccgatgatttcttgtgtatgagctccagcaaccacaaaagcatagtcgtgggcttcgccgtaaatatcaaggtaggttgctgttgggatatttactttcttacggaagtattcaatttgctcactaaatggcaagggttgtgcaacaatgctcatcgcttggcttcctgtttcacttcatagcgaccacgcaatgtcgccgtggttagcccttcggcaaacagttgtgcatattcactaaaatctaactggggcaaaatatcatctaaaatttgttgagcttcttctaggctctcggcggtatcaagtcttgctctaacttgagcaatattagcgtttaatgaatactgagaaagttcacccatttggctgacaatccgatccatttctgtttcgtgatggtgatgttctgcaaaatttaccgtcgaactcaccgcttgtagctcaatatcaccatcttcaaagccatattcacgcataaagtattgcttcgtaaaccgcacacccattcggtgtagcttctcatcacgctcaacttgctcggtatttatgctttcttgctcaaaaaactcaaatgtaggcaactgctcgacattgaagttatagtgacaaatccattgcaacaaggtgttgaaagtggcttcaagcattgccttgtcatcgttacgaatatcttcaatcacttcaagccctgcggtagccgatgcacgattactttcttgctctgtcgtttggttttgccccaataacgcaatattgatttcacctttacagaacgctaagaacttctcgtaactgtcgctagaagcccctttacctgcggactccacaatgtccacgctggcatcatcagggataactgcaatggctgttcctatcattgcttctaggctatcagccaaacgatctttttcaggctctgatgtcgtgcgagggtgtttaccgataagccacggcgagccgtatttttcggtaaactctaaccaatatttaaaaccgcctttcttaaaggttgccgcccaaaagcacagcgataaatcgcctaagccgtatgggttgtcttgggtcgcttcttgcgtagttaaaaggaatttatgctcaggcagtaactccccatcaatccaatgctccttggtacgaaagcgaagctgattgtcttcatcaaacacaaaccattcgggctttttaccgataatttcagctggcacaatcaaaccatcacgctccgcccaaatcacttcagaaacttgataaccaaacagcgaagcgtttagcatttcggtgatgatgttatttaatggcaagcggttaaatacttgataaagttgctcatcaactttttcattattcgtggtcgtaattcgccactctaagcctttaattgccgcctttctgcgacggacacctgaacgaacttgcccatccgatagtaattcacgataaacagcaatgtctttccccatttttttgagaataggatcagggttcggcagatgataccccgttgcccaatggtcaaaacttcttgcacgagtggcaatttcgctgattaagtcttttttatttttcatatcctaataaccttcagaaagttgctggctacgacgtggtttgcgtgctagtggtgcaacaggttgcttcacatcagatgccgcatacaacgctaagaaacaagcccaagttctatctgcgtgaccttgactatctcgttctgcaacaaagcgtggctgaccattagctccagtcacctttttgagcttatgcaaatcttctcgtaatactttatctccctgcggaatgcgtagtcgtttatcttcaaatacttcttttccaagggtagcaagcatcattttattcgtttgggtgaaaataaccccttcaactcggtattcaccgaaacggcgtttagcatcttctacgggtttctcccctaagcctgtttggtcaatacaacaacgcaatacacggtattctacaaatactcggtcaagctcagcatcttgtgttgcaaaactcgctcgttttaaagcggtgatttctcttgtccagaatacatcacctactagttcaataacccaaataataaataggtcatttcgcaccccaatatcaacgccgacaaaacacgggttacctgtatagtggaatggtaatcctgcgtgtgaatgctcaacaccatcaatcaaatcataagaaagccaactacttgcttcatctaaccatttcaactcaaactcttgagcccacgcatcttcatcatttaagcccactcttaactgttctacattacgtggtaagccatctgcaacagcctgataaatatcaaccgagtggcgtgaccattcactattatttaagtcagtcatcaattcgtagaacttgttacctttaccatttggggtagaaacaactcgcaatttccaaccagcagaaattacagggaatagggctttccaaatttcacggctatcttggtggaatccaaactcatctaagaacacatttgctgagaaaccacgagccgtgtcaggattggctggtaatgcagtgatttttgaaccgttagggaagatcacttctagggcattaatcgtagtgtcttctttaaaaggcacttctaatacttcgcaaacaatccccattgcttcaagatggcgttttaccccttcattcatcgcttctttcgcttggcgttctccacgagaaaggatcacccagcgagtacgttcgccgttggcttctgcttctaagcaatccagtacaatttcaagggtagtggtaaatgttttacctgtttgacgagcaaacattgctactttgaaacggcttttatcgtttaaccatcgcttttgatagtcatagagaacggtgttattcaatgccataaactgcttttaccatttttgtcacatcttcaagggatagtcctgcctgtgtaccactttcttctacggctttagctgcttgttcaatcacttccttgcggattttacgttcacgctcatagcttaaactttccgcctgttccaaacgttgtaatgctgacgataacaatgctaaatctttcggctcaataccaccttcttgttcacccaatctaatggacgtttcaaaggcaatattcttcaccatttccatcacgattttcccaatgtcagactgcggagcttcaccaaattgtttcgtccaaatttctgccacttctcgtgcattacggattttacttgccattttttccatacggttggcatagcgatttagccctgttttacttaaacaatagctttcatcaagcccacaatcacgaatcagatcgttaatttcttctagaatttgcgtttgtgaatattgcttgtcacgcagcatcattgccagttggcttttgatgttcggcggtaataaatcaactttactcgcacgcccacgggtcgttttctcattcatttaaacgctccttaaatatcctttaaaaaccgtttaaaccttaggtcttgggcgttttaccccttcaaccgtcactcgaccttgagcgacatctaacccacgttgcgtaatgctggcaaccatatagccatcttttaaacgctcaagctgaataagcccttgttcttctagccatacaaggtgattacgcacaagatcacggctaatatcgtgaccatataaatcaaggcaatcacttaaaatagactcattggcatcatagccagcctcggcaagagaacgtaaaatcactaagcgttgatctttagttaaaattgtctgcatacatcattcctttaatactttagcttcaagtaataagccaacttggtgatttattgaagtcatttttgcattagccgtttgcgtttcccctcgcacttccgtcattaaaatttcaagtcttgccacatcttgagcggtgggtaagttatccacttttgtttcaagctgagttagacgacggtcatagtgttcaacattttcagcaagggtattcacatcggattttttggcatacttactatccatttttagccaaaatccagccccaactaaaccaataacagtagaaatcaaggcgaaatgttggcgtaagaaatccagaatctctgtcatttagactgctccttacagacttcttcataggtcagattgtgtgctagtacttggcgtttcgtttccgtcgtgtcctgacgacttgggtaaatcagcccgaatgctgtgcaacctgtcgtcgtcacggaagtagttgtgtgcgtgcaactgctcatcaacggtatcagggctaacacgctgaacattttcacgatgcgtttgttgaatttttgcattttgtacctctgcatttttttgctgaatttcgaccgcttgttgttggttttctgcctgtagtttccgatttcgttcttcagctttttcaaccttgagccaaagccaaaacaaaacacaggcagcaagaaataacactacggtcacaatttttactgtcatcattcaaattctccttgtcgcttgctactcaaggcattcgcaaaccctttcgttgccacttgaccaccacagaacactgcaaaggtcataaataattcaggcacataactgcgatctaaatagacgcaataagccaaaatcgctgacatcaacaacgccccgaaaaactggataaatccagtggtcgaaaggcgaccgtctgaattagtaaagagttctgcaaatttagccattaccaataccacccacgttctaataaaatcacttcagcggtagtgtaacgaccgccattttttgcacgactgcgtttagcgttgttgctgagttttttcattattcatctcccacatcatcagcgatataacgcagattgcctgccatacggcgaatccagcccttgccaaaatgttggaaaccactgagcttggtgtagaactcaaggcgttctgcattgaaaagggtaacgacttccacggtggaacgcttacgaattgccgtaagggtaatctcgccaataatgccatcatcaacgacacccacagcacgttgtagcatacggctggcattacccgaaccgtgattgacacaggcatcaaaaaactgaaaggcaagctcagggggaaattcattgcaacgatagcgttgccaaaaggcttttaaatagatttgcttggcatcatcacgagtcattgtgaacattgaccctgtatagccatttgcacgagcagtgtgaatggtgataccgaatttggtttcaccgcctgcatctcgtgggtcattcacatagccaccttcgtgttgaataacacgagcaaaggctttgttaaaatcagaaagagttgcggtttgggacataaaaaactccgttgtaaaggtttaacttcacaacggagtttataaaaaagagggttaaatggattttaaactagtttaagaaacttttgtatgaataaccgttattttaataaccatcagaccaacggctactgcgatgtctgacaaccgcacattccatttctattctcttatattgaattttagcgaggcaatgatgacaagaaagcatttcaaaataaccttctatagggcttggttgaaggatcgatttcttaccctgatggaagcaatttgcacaaagataatgaaacacaatctccccgttcgcattggtaaagcactgattggagcgataaacgaatgcccccgtggaaaattgaaatggcgaatactggtctttctctactttaaatttgcgaagttggctgatctctgcttccaaatcagctttagagctttgcaacgtcagcaagtcgctttgcaaagagagaaccaaaccttgtaattgaatagcaatttgggtgacttccagtgttttggcactggtttcacctattgcttttaaatgttcgatatcgtcttttaatttaccaacagtttctaatgcatttttgattgttttagcggactcataaacatctctaatcatttcttcttccctccacacaaactctcgcaaggtataccgtctttatcacggtcgaggctactgacaccgcattgagtgaggtgaaaacgagcttcttcgcagctgtccatttggctacaggtgcgtttgctacaagtgaaggtttgagcgaatgcaaaggtggcaatcgctgccaccaataatgtaataaggagctttttcatagattgaaccctattcagcaaaccctgcagatgacattacaccagtataagaactcacgctgacagagtattttttaccgttgaaaatgaattcttgtttttggtctttgttggttttaccgtaatcattcatcgtgctagatagcatctccataaattttttacctacggttttaagttgattttttccttcaaaggcagaaagtacggctgcatttgagaacagcataaccatattttcatctccaccttctgatttaggtgtcacaatcgtgagtatgctcatcactttttgtgttttcttatcgatcgccatcacaattccgaaattttttgagaattggtagcttgctgtatcatttaccgcccctttttctacttttattttctttgccatttggtaaggcgaaccaatttctgttagggctgtgttaatgagttgtgctaattggttggcgttaagatctaaggtttgattaactttttcaggctcagcaggttgtttttctgcgttaggttcttcttttgttgctacttcaggggctttttcttctgctgctggagctggttttatttcttctttcggtggcgtagcaataggttcttttggttgttctactttggtggtttcttctggttgtactggtgctggggaaatgattagtacactaatgacaaatcctaacgcaccaattgcaaacccagctaaatggcgaacaaatgctcctttgcctttattcttataaaatcttgcaataacaatccataatgcaataaataaaataaatggaataaagttaatcattttcaagtttccttatagttggttaaaaaattctacgctactttacgattcgtaagtgccgccgtcgccgccaaagcacttgcggcttcttcgatggcggctttaccctgctcgttgctttctcggtagtcttcaagtagggtttgttctttttgggtgagcgtgctttcaggtgtgctttgcaccccagaaaagaccctatcccaaattctgtgtaaacacccatttcaacttaatggtgatcgtctaggcgatcaccaaaatcaatcataaatcgattcatcgccagtttccagttctgaatcggcattgtccatttttttggtgcatctttaatcgcaagccaaatcactttgaaaacggaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtaggggcttgataaacctgctttaaatctgcagtgacggctttgtaatctttccacgaaacgaatttcaagctgttacgcactaaatgcacaatgcaaagctgaatcttcgttttaggatagactgcattgatggcttctgggaagccttttaaaccgtctacacaggcaataaaaatgtcttttaagcctcgattttgaagctctgtcagcacattcgcccagaacttcgcaccttcattttcagcaatccaaagccccaataactctttatgtccttcaagattcacacccaaggcaacaaacacggatttgttgataattcgtccatcttggcgtactttcactacgatacaatctaggtaaacaattggataaaccgcatcaagtgggcgattttgccattccattacgcgttctttcacggcgtcggtaacgcgagaaatcaggctgcttgacacatccgcatcatagagttctttgaacatttcaacgatttcctgattacttaaccctttggaatataaggcaataatctgctcatccattcctgtgatgcgggtttgatttttcttgataagttgcggttcaaaggtgccgtcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttccggtgtttttagatttttggcaaattccgctgccaaggcgtgaagttgtttttcgttcataataaaatacctgtgtctgaatgtattatctcagaaacaggtatttacacaaattgtgggagaggctcttggtttaattatttttcctaattattaccaactctttttatttaaaaaatcctttataaacataatcttatgctttttcgttaatccattatgaaccgataatttctgcttcagttctttaaataacccttccaaccgatttgttgttttttctatatttaagtgagaatattcttcaaaggtgaataaatatttcatatagtattttaaactagcataagcccctcttacattacggtgtttataaggaaaatatcctttctcattgggatattcagaccgttcatctaaaaacgctttatgttttaaataccattgatgtaatctcaaataaaattcatttttgtggctttcttttagcgtttttacaataatctttaattctttacccgcttgtgattgatgtttttttcttaatttcctcatcacaattgccaccatatgaaattgacacatctgtactggtgtattaaataaataaatcttggggccgtcctagataaccaacttaaactgcccttaaccaattgttttaaaatggaaatttgagatttttagttactgtgattaaaacgccattcgcattccttcaaatacaactcaaaatgtgctttgggaataccgttaaacttgcctaaatgacgtttagcttggttccaaaaattttcaattccgtttatatgattttgtttttctgcgaaatgagtactgtgattgatacgaaaatgattaaactcactcacatcaagaacatcatagcttcgataaaaatcggtgtaaacaatgcggtcaggcttcaccttttctcgaataatcggtaaaagtgtcgcagattgagtattcggtacaacgacagtatataccttaccatcacgctttaaaagcccgaatacagcggttttacccacagctccacgacctcgtttacctttgcgagtggccgccaaaatagctttcatcggcttcaatttcaccttcaaacatctccatatgtgggctgttttgatagataagcaatcgcagacgatagaagtaataggctgctgtcgttttatttacatttaccaactcagccgctctgttcgagcagtgacacctgccacaaacagctcaatgagtttattttgtttatgctgatttgaacgactttttctcatttggttattttaacttaaaatagagcttttagtcgttatctaggacagcccccaaaattattgcattgacacttaaacagagcgctaaaaaagacttctatttacgattacatcattggtatttaaaacataaagcgtttttagaagaatggtcagataaaccgaatgaaaagggctattatccttataaacatcggaatgtaagaagtgcttatcatagttttaaacgttatatggattatctatttacctatgaaaagcatgacgatttaaatatcgaaaaaacgacaaatagacttgaaaacttatttgggcaactaaaggaaaaattatcgcatcatacaggattaatgaaaagacataagattatgtttataaaggattttttaaataaaaagagttgctaagaataattaaaaatattcattagcaaccattttgtctactatgccagaaaaatattagcctgcttttgagataatattaaagaatattctcaaacttcgctaacatctctttcggccatacgcttgattgcacttcaccgatatgttttttacgcaataagaacattgccatacgagattgaccgataccgccaccgattgaaagtggtaaacgtcctgctaataaatctttgtgccagtccatttctaaacggtcttcgtcgcctgttaatgccacttgtaagcgtagtgcggtttcatcaacacggatacccattgatgataattcaaatgccgtaccaagttgttcgttccaaactaagatgtcgccgtttaagcctttatattcgccttccgataccgttgtccagtcgtcgtagtctggagcacgtccgtcgtgcgctttgccgtctgataatttgccaccgatgccgattaggaataccgctccgtattctttacaaatcgcattttcacgctctttgctggttaatgttgggtagcgtttcactaaatcttcgctgtgaacaaaggcaatctcttttggtaatagagacggaatatcaaaacgtgcttcaacggctaattcggttaaacgaactgcacggtagattgagcgaacagtctgttttagatagtcgaaattgcgttttcctgctgggatcactttttcccagtcccattgatccacataaacagagtgtgttggatcgagtgagtcttcatctgggcgtaacgctttcatatggacgaataagccttcgccttcttggaaaccaaaacgtgcaagggtgtggcgtttccatttagcgagtgagtgaactacttcataaactgcacctgggatacattttacgttcacttgtaccgctttttcgatacctgataagttatcctgtataccgttgcctacttcacttaaaattgggccttgtacttcaataatatctaactgttcgatgaggttttgggtaaaggtgttcttaacaaagctgatttcttgttgttgaagaataaatgatttttgcataataaatttccttttgaataaattctgtaagagatgtgcgtaatttaaattaattcttgataaacgcaataacttacataaaaaaatcaaacaaagttaatctatattagatattatttaataatttatgctatattttagttaatttctaacaaaaaatagaaaaggaacagaaaatgcataaaaactatcaggcaacatcgcagattgacttactggatcaacaaattctgcaagttttaacccaagatgctcgagttccctatgctgaaatggcaaaaaattttggggtgagtgcagggacaattcacgttcgtgttgaaaaaatgcgtcaagcaggaattattgaaggcactaaagtacgcattaatccgcgtaaactgggctatgatgtctgctgttttattgggattattctaaaaagtgcgaaggattatgaaaaggtgattgcaaagttgcaggagtttgatgaagtggttgaagcctattacaccacgggggattactctatttttattaaagtaatgacccataccattcaagaattgcactatgttttagctactaaaattcagggtattgatgaaattcaatcaacagacaccctaatttcaatgcaaaatccaattttgcgagaaattaaacctcaagcaaacgtttccagttgatcttgttcacatttttgaacattggtttgcaaaaaagatcgcaattctgaccgcttgattggtagaatgaagcggttaggttactcgaatttttctcaaaaggagtcaattatgtcagaagtgtttcatcttggcttaaccaaagcaatgttaaaaggagcgaaagtcgctattgttccaggcgatccagctcgtagtgagcgtatcgcagcaaaaatggataacccagagttcttagcttcaacccgtgaatttacatcgtggttaggttatgtaggcggtcagccaattgtggtttgctcaacaggtattggcgggccatcggtttctatctgtgttgaagagcttgctcaattaggcgtgcgtactttcttgcgtattggtacaacaggggcaatccaaccgcatattaatgtaggtgatgtgttggtaacgacaggtgcagtacgtttagacggggcaagtcgccattttgcaccattagaatatccagcggtggctgatttccgttgtacgaatgagctttatgcggcagcgaaaaatcaaggtattgatccttatgttggtattacggcgtcatctgatactttctacccaggtcaagagcgttacgatacattcacaggtaaaatctaccgtcatttccaaggctcattaaaacagtggcaagatctgaatgtgatgaactttgaaatggaatcaggcactttatttaccatgtgttctgcattaggcttacgttcaggaatggttgcaggtgtaatcgtaaaccgtactcaacaagagatcccaaacgaagcaaccattaaaggcactgaagatcgtgcggtttccgtggtggtagaagctgcgggtaaattggctcaagattataaataaaatgttgatgaggcagtgtgaatatctcagactgcctcagtttttataagggattcgggttagtctatctcttttcttgtttttatatcaataaaccattgatcttttcccaagttttagctttaatgcttgcccaattttgatttttctaaataaaagtgtaaatagaggcaattatggcagaaagttttagcgtaacacgtcgttttttcgacgataaaaattatcctcgtggtttctctcgtcacggtgattacaccattcgtgaatcgcaaaccctagagcaatttggtcaagcctgcttagcattagaaaacggtgaacgtgaacctgctacagcggaagaaaaacagttcgtagccgttgttaaaggtgaaaaagttgcagaaactttcttagaaaaaacgtggcttaaataccgtgatttaaccagcaaaaccaaacgcatttacaccctttcaggcgatgtaagtggcgatcttggtggcgatgattcagcagaataatatgtgggaaggcttgaaaagccttttcttttttctttcttgataaattcaaatgaccttaccaattcatcaatatccagcgttacttgcaaaaaaggcagagaatctcaccgctctacttgcaccttttaatgcacctgaacttgacgtttttgcctctgacacaagccattttcgcttgcgtgcagaatttcgtgtttggcatgataatggtgatctctatcacattatgttcgatcaggcgactaagcaacgctaccgtgtcgatcaatttccgattgcaagccaactgattaatcgaatgatgacggtgttgctggctgaaatcaaagacaatgagctacttacacgtaagctgtttcagattgactatttaagtacattaagtgggcaaatcgccgtttcaatgctttatcataaatcgctgacagaagaatggatagagcaagcgaagttacttaaacaacggttgatcggctatggctttgatgtccagttaatcgggcgtgcgacgaagcaaaaaattgcattagattgtgattatgtagaagaagccttgaatgttgatgggcaaatttaccgctatcgccaagtagaaaacagctttacgcagcccaatggcaaaatgaacatcaaaatgttggaatgggcgagagcttgtacggcaaatagtaagggtgatttattagaactctattgtggcaatggtaatttttcaattgcgttagcaaatcaatttcgtaaggtattagcgactgaaatttcaaaatcatcggtagaatctgcccaatataatattgcagtaaacggcgtagataacttgcaaattatccgaatgtctgcggaagaatttacggaagcgatgaatggcgttcgggtcttttaccgcttacgtggtattgatttgaaacaatatgattgcaataccatttttgttgatccgccacgagtagggcttgatcaagccacattagaaatggtgcagggctatgaaagaatcctctatatctcttgcaatccacatacgttagccgacaatttaaaacaattaactcaaactcaccgcattgaacgctgtgcattgttcgatcaattcccttacaccgagcatattgaaagtggggtttggttaattcgtaacagctaagtaggcgaaaaatagaacatttgacggttttgcatcattttgtgcttgacctagttcagagttatctatactattttacctgttttcagcggaggaatggcagagcggttgaatgcaccggtcttgaaaaccggcgagggttaacgccctccgtgagttcgaatctcacttcctccgccactgaatatacagcctgttgataagcaattatcagcaggttttcgctctaaagagcaaataaaaattaaaaatagctttcaactcggaggaatggcagagcggttgaatgcaccggtcttgaaaaccggcgagggttaatgccctccgtgagttcgaatctcacttcctccgccaactaaacatagaaaatatgaataatctaagctgaacgggattttcttagtttttagttacaatttattctcgctgtagatctcaaataatctttgggtaattatgttcatgagtcggtctacatcaggactattatcattattttcaagagtccttgctctaaatcagatatccaatattattaaataggtttgacttctattgagttctattttagaatgagttagtcctttcgtctgtgaaaggcttttttattgttttaatcttaactggagctttattaatggcaactatcaaccagctagtacgcaaaccgcgtgtgaaaaaggttgtaaaaagcaacgttcctgcattagaggcttgcccgcagaaacgtggtgtgtgtactcgtgtatacactacaactcctagaaaaccaaactcagcgttacgtaaagtatgtcgtatccgcttaacaaacggttttgaagtaacttcttatatcggtggtgaaggtcacaaccttcaagagcacagtgttgtgttaatccgtggtggtcgtgttaaagacttaccgggtgtgcgttatcacactgtacgtggtgcacttgactgtgcaggcgttaaagaccgtaaacaaggtcgttctaaatacggcgttaaacgtcctaagtcttaatggttctccgttaagtaaggccaaacgtctaattagtcaaactatttaaaccataaactccagtcaatgcgactttgtcgccatagagttttggataatcctgaagatttataatacggagaaattgcaatgccacgtcgtcgtagtattgaacctcgcaagattcttccagatccgaagttcggttcagaattacttgcaaaattcatcaacgttttaatggttgatggtaaaaaatctatcgcagaatcaatcgtttataatgcgttagaaacattagctcaacgctctggtaaagatgcgttagaagcattcgaaatcgcacttgaaaatgtgcgtccaacagttgaggttaaatctcgtcgtgttggtggttctacttaccaagtaccagtagaagttcgtccaactcgtcgtaatgcattagcaatgcgttggattgttgaagctgcgcgtaaacgtggcgataaatcaatggcaatgcgtttagctaacgaactttcagatgcagcagacaacaaaggctcagcagtgaaaaaacgtgaagatgttcaccgtatggctgaagctaacaaagcgtttgctcactatcgttggtaataagcttttgatgtttgtaggcttcatctcaaaatttgcgatgaagcctattactatataaacaaattcacattagattcccaaaaaggtaataataatggctcgtacaactcccattgagcgctatcgtaatatcggtatcagtgctcacatcgacgcaggtaaaacaactacctctgagcgtatccttttctatacaggtgtaagtcacaaaatcggtgaagtacacgatggtgcagcgacgatggactggatggaacaagaacaagagcgtggtattacaatcacctcagctgcaacaacagcgttctggtctggtatgtcgcaacaatatccacaacaccgtatcaacgtcatcgatactccgggacacgttgacttcacaatcgaagttgaacgttcaatgcgtgttcttgacggtgcggtaatggtttactgtgcggttggtggtgttcaaccacaatctgaaactgtatggcgtcaagctaacaaatataaagttccacgtattgcgttcgtaaacaaaatggaccgtactggtgcaaacttcctacgtgttgttgagcaaatcaaaactcgtttaggtggtaactctgttccgcttcaacttccaatcggtgctgaagaaaacttcactggtgttgttgatttaatcaaaatgaaagcaattaactggaatgaagctgaccaaggtatgacgttcacttatgaagatgttccagcagaaatgcttgctgagtgtgaagaatggcgtaacaaccttgtagaagcagcagcagaagcttcagaagagttaatggaaaaattcttcgcaggtgaagaattaactgaagaagaaattaaatctgcattacgtcaacgcgtactttcaggtgaaataatcccagtttgctgtggttctgcattcaaaaacaaaggtgttcaagcaatgcttgatgcggtaatcgactacttaccagcaccaacagacattccagcaatcgaaggtatcaatgaagatggtacaccaggcgagcgtcacgcaagcgatgatgagccattctcttcattagcattcaaaattgcaactgacccattcgtaggtaacttaaccttcttccgtgtgtactcaggtgtaattaactctggtgatacagtttataactctgtaaaacaaaaacgtgagcgtttcggtcgtatcgtacagatgcacgcaaacaaacgtgatgaaatcaaagaagttcgtgcaggcgacatcgctgcagcaatcggcttaaaagatgtgggtacaggtgatacattatgtgcgcaagaagcaccaatcattcttgagcgtatggaattcccagagccagtaatctctgttgcggtagaaccaaaaactaaagctgaccaagagaaaatgggcttagcattaggtcgtttagcacaagaagacccttcattccgtgttcacaccgatgaagagtcaggcgaaaccatcatttcaggtatgggtgagttacacttagacatcatcgttgaccgtatgaaacgtgagttcaaggtggaagcaaacatcggtaaaccacaagtatcttaccgtgaaactatccgtactcgtgttaatgatgttgaaggtaaacatgcaaaacaatcaggtggtcgtggtcaatatggtcacgttgttatcgacttatatccattagatccagaaggtccaggatatgagttcgtgaacgaaatcaaaggtggtgtaatccctggtgaatatatccctgcggttgataaaggtatccaagaacaacttaaatctggtccattagcgggctacccagtagtggatttaggtgtacgtttacacttcggttcataccacgatgttgactcatcagaattagcgttcaaattagcagcgtcattagcattcaaagcagcgtttgctaaagcaaacccagttctacttgagccaattatgaaagtggaagttgaaactccaccagattatgtgggtgacgttatcggtgacttaagccgtcgtcgtgctatggtaaacggtcaagaagcgaacgagtttgtcgttaaaatcaatgctgaagttccactttcagaaatgtttggttatgcaacagacttacgttcacaaactcaaggtcgtgcatcatactcaatggaaccgttaaaatatgctgaagctccaacaagtgttgcggcagcagttatcgaagcgcgtaaaaaataatttttaacttacaaactccgtagcacatatcgtgctatgggatttcatcaacaaaggaaactttacaatggctaaagaacaatttaatcgtggcgataaagtccacgtaaacgtaggtacaatcggtcacgttgaccacggtaaaacaaccttaacagcagcaatcacaaccgttcttgcgaaaaaattcggtggtgctgcgcgtgcgtttgatcaaatcgacaacgcaccagaagagaaagcgcgtggtattaccatcaatacttcacacgttgagtacaacacagaatcacgtcactatgcacacgttgactgcccaggacacgcggactatgttaaaaatatgattactggtgcggcacaaatggacggcgcaatcttagtagttgcagcaacagatggtccaatgccacaaactcgtgagcacatcttattaggtcgccaagtaggtgttccatacatcatcgtattcttaaacaaatgcgacatggttgacgatgaagagttattagaattagttgagatggaagttcgtgaacttctttcacaatatgacttcccaggtgatgacacaccaatcgtacgtggttcagcgttacaagcgttaaacggcgtgccagagtgggaagggaaaattcttgaattagcaaaccacttagacaactacattccagagccagagcgtgcgattgataaaccattcttattaccaatcgaagacgtattctcaatttcaggtcgtggtacagtagtaacaggtcgtgttgagcgtggtatcattaaagcaggtgaagaggttgaaatcgttggtatcaaggatacaactaaaacaactgtaactggtgttgagatgttccgtaaattattagacgaaggtcgtgcgggtgagaacgttggtgcattattacgcggtaccaaacgtgaagaaatcgaacgtggtcaagtattagctaaaccgggttctatcactccacacacagacttcgaatcagaagtttacgtattatcaaaagaagaaggtggtcgtcatactccattcttcaaaggctatcgtccacagttctacttccgtacaactgacgtaactggtactatcgaattaccagaaggcgtagagatggtaatgcctggcgataacatcaaaatgacagtaagcttaattcacccaatcgcaatggacgaaggtttacgtttcgctatccgtgaaggtggccgtaccgttggtgctggtgttgttgcgaaaatcatcaaataatctgtttttagtttaagaagattagattgttatcttaagggcatagtagataaaacggttgttaattcgtcaaaaactatgcctatatgacaaagtggttgctaatgaatattttaattattcttagcaactctttttatttaaaaaatcccgtataaacaacatcttacgttttttagttaatccattgtgattatttaattttcgcttaagttcactaaataacccctctaaacgatttgtcgtcttttctatatttaattcagaatgtttttcataggtaaaaatataatgctttaaactggcataagcacttcttacattgctatgtttataaggaaaatagtctttttcattcgctttatcactcctttcttttaaaaaatcttgatgttttataaaccaagaatgtaatcgccgataaaattcatttttgagcttcttgtgagtgtttttgcaattatttttaattctttacccgcttgtgattggtgcttttttcttaattttcgaatcacaatcgctaccatatgaaattgacacatttgtactggtgtattaaataaatctttcatcaaaccacgtctaccatcacaggtaatcgattgaattatatagcctttttcccttaacctattcagggcaagtttgtagtaaatatctttttcggttcgcacaaagtaatgggaaatcacattatttgaattagaatccattagcactaatacgccaaaataacgacagaaaaacgttgtatccataatgatgtttaggtatcgatttgaaggtagttttaaagctgttttagggactttatcaatatatctttgaatagttctaaccgaacaatgatatttttcggcaagttgttgataggtttgttttccggatgtgtaatcagtccaaattttaattgaatctaatttagattttaagataaacgttttataacattcattacaaaaataacgttgagtattattttgtatatcatgtttcttgattttctgactttggcaaaatgggcagttttttgttcatatttcaaaaaagagggcttaaagccttgtactataagactttaagccactttttagcaattgttttgtctattacaacaacaaaaaccgcccattttatctactgcaccacctattttcataaaaaggattaaggcgactataataacttctgtcttacaatctcaaacagacaaaccccggtcgccacggatacatttaacgacgataccgatcctgccattggaatactcaccagttgatcacaatgttcacgggtaagacgacgcattccgtctccttctgcccccatcactaacgcaatcgatcctgttaatttcacctgatacagactttctgtcgcttcgccagctgtgccgacgatccagatattgcgttcttgtaactcacgcattgtacgggcaagatttgtcactcgaataagtggcacggtttctgctgcaccgcaagccactttgcgagctgttgaagtgagctgtgctgatttgtcttttggtacaataacgacatcaacccctgcggcatcagcagtacgcaaacaagcccctaagttatggggatcggtcactccgtctaagatcaataaaaacggatttgctttgcgatctaaaatttggtcaagatcgctttcatttagctctttagcttgaatgactttggcgataatcccttgatgtacttcgccttgcactttgttatcgagtgcttgacgattgacctgttgcactcgaatgcctaaacgctgtaattcgttgagtaatggggttaatcgtttatcttcacgaccttttagtacaaacacttcgattaatcgttcgggtgcaacatctaaaaaggatttaacagcgtgaataccgtagatttgttcgctcatatttattcttctattctgtatcttatttttcccctctctcgtttacgggagagggtggagaaaaatccgcaggattttcggagggagagggcaattaatgttctcttgttttaaagaactccacatccggataacgctcttgagccaagttgagattaaccattgttggggcgatataggttaagttatcgccaccgtctaaggctaaattctgctcgtttttgcgtttaaattcttcaaacttcttggcatctttacattccacccaacgagcagttgctacattgacggtttcgtagattgcttccacgttatattcggttttcaggcgtgaaacgaccacatcaaactgaagcacaccgaccgcaccaacgattaagtcgttattcatcagtggacggaacacttgcacagcaccttcttccgacagttgtaccaagcctttaagcaactgtttctgcttaagcggatcttttaggcggatacggcggaacaattcaggggcgaagttcggaataccggtaaatttcaagttttcgccttgcgtaaaggtatcgccgatttggatcgtaccgtgattgtgtaagccgataatatcgcctgcgtaggcttcttctgcgtgggagcgttcgcctgccataaaggttaaagcatcggagatgatcacatctttgccgatacgaacgtgcttgagcttcattcctttttcatatttgcccgatactacacgcataaaagcaacacggtctcggtgttttggatccatatttgcttgaattttgaacacaaagccactgaatttttcttcacttgcttctactttgcgtaaatcagcttcacgggcttgcggagcaggcgcccactcggttaagctatctaggaagtgatcaactccaaagttacctaacgccgtaccgaagaaaacaggcgttaattcgccgtttaagaaggcgtctagttcaaattcgtggcttgccccttgcaccagttctaattcgtcacgcagttgctgagccaaatcatcgcccacagcttgatctaactctggattatttagccctttgacaatacgcacttcctgaatggtatgcccttgccctgtttggtagagataggtttcgtctttatagagatgataaacgcctttgaacaacttaccgcaaccaatcggccaagtgatcggcacgcagttgatcttcaacacgctctcaacttcgtctaacaattccatcggatcacgaatatcacggtcgagcttgttcataaaggttaaaatcggcgtatcacgcaagcgggttacttccatcaatttgatggtacgttcttcaaccccttttgcactgtcgattaccattaaacagctatccaccgccgttaaggtacgataggtatcttccgagaagtcttcgtgccctggtgtgtcgagtagattgactaagcaatcattgtaagggaactgcattacggaggtagtaatcgaaatcccacgttgcttttccatttccatccagtcggatttagcgtgcgcttgtgagcctttaccttttaccgaacctgcggtttgaatggcatttccgtaaagtaacactttttcggtgatggtcgttttaccagcgtcggggtgagaaataatcgcaaaagttctgcgtttatttacttcttgagggtaattatttaatgacattctattctcgttttctttttcaaaaatggtggctattttccctgatttagtcagagatcacaaccgacggggatgggttatattaagatttgcaaactattgacaaaaactgaccgctaataaaattttatttatcccgatcatctacgccaattagcaaatagttgccttgaatatctgctaaacttctaaaaccgatattaaaaatttcacaggccttattacgattaattagacgataatcaaaattatcgtggtgatgtccgtgaaaaatcttcttcacgcccatttttcgagccagttgattaatcactgcaaaaccttgtgggtgtgggcgaggagcttcgtgggtaattaaaatatctgctttttgcgtttctaaaccttccacatctgaaggaaaaattgaggtacggtgacgcagtggtacaccacctcgccaaatacgctcttgtggactatattggcaataatggataggatcaaagaacattgggcggtgaggaggcatccagatatgccctctaaaaacgccccctagtcctgcaatttttgtgccttgtatattgacaacgcgaccgtgaagatttcgttctttccaagcagttccccaaatagcatcatacgcagcaaccgttttactatcgtggttaccgtgaataaaccaaatatcgcagtgttgagccagcttatccaactctgcggtcgtggttaattgcaaatcccctaaaatcactaacgccacattctcacgttcttgaacaaaggggtaaaggtggacgtagctaccgtgaggatcgcccgcaaaaagtatcattcgctcttctcgttttggtttttaaaagttaatgttatggattcttcatttaagatcgcttcaatcactgctttggtttgattataacgatctaaataacttggcgattcaatttcaatataaggtacgttatatttttctaacaattttttgagtaactgctggaagcgttggcgttgtttttgtgaacctaaactacgcagaccatcatcaacccatttagtgttatttgataataaaatagtgacatcaaaaggatattctttaatcatcgaatctaagaatgggtgaggtttgccttcatattgaatacagaatgcttgagtagtaatgtaatccgtatcaacgatcgccactttgtgtgcgtgcttcattgcataatcaacataacgcttatgccctaatgccatttgtggatagtctgaatactgcattgcctgttcatcaccgccaagttgttcaaagacaaattctcgcccgtattcccacgccgatgtcgtattaaatacattagcaagtttgctgactagaacagtttttccgctactttcaccacctaaaatagcgatagttttcacaaagaatggacgcacctcttttggaataaaacgccagtattggaacggattgttgcggatctttgtcgctgatacattaaatgagttacgttcaggatcgaccaaatgcacttccaaatttaagtatttctcgtaaggtgctttatcttggatctcactgctaaagactaatgttggctgaatatgtttttcagcaaatagctctttgacacgttccacccagccctcccagccgtttggatagctaggaataccatcttcaaccaaatgatgaatgaaaatctgtttttgctgatatttaaaaatctgttgcatccaacgcaaacgatcttcattcgttggcatacgtttcattttactatcacggaacagttgtaaatcacgttcagtatcggtacaaacaataacgtgtagcatatccaccttactaaaggcttcataaatcatattaatatgccccgtatgcactggatagaacttaccaaaaattacgcctactcgttgattttgttcctcaacgatattcaacactttatgcaacgcacctaattttgtcgcacttggatttttaattttccccgacactaattgattaaaataggctctagttacccctgcttgctcacaaacatcatttacttttagctttaactgtttacgtttttgttgaagataagcaaaatttgtcataagttcgtcctcacattgatagacagaatgataggcgaaatcgacctttttgtcatttaaaaatgtatagtcaagcggtaagatttacataacaaattgcaaaattatgtataaagactttctacttttgcactattcggtataatctcgcttccaaattattcctcatttaacaaattatggcgttattgattacccacaaatgtaccaactgcgatatgtgcgagcctgagtgtcctaatcaagcgatctcaatgggcgatgaaatttatgtcatcgatcccgatctttgcacggagtgtgttggacattacgaaacgccgacctgccaaaaagtgtgtccgatcaacaactgtatcatcaccgatcctgagcatattgaaactaatgaacagctttgggaacggtttgtattgattcatcattcggataaactatgataactttctgattcgttgagctaattcactaacctgctgccaatctgtatattcatactctctgctagtatctgtatcacctttcgttattttcataataaagcgaatcatggttttatcaaaaaaattatagcgaggatagagtaatgctccagcaaatacttcagcgatatttggtttccatagaattttgtctagcaatttacgtgtatatgtattcgtataaggtgtattacgagttattttacgagcagttaaattgacactaaaaaaaacagatttttttctatttagtagctcataatatcgatcaataaattgttccaatactgggtcaaaatgtccatatcgaatcgatgcgccaataacaatacaatcaaattgttctaatgtttctacagaccaaagagaaaagtctcgtaaggagaaaacttgtgtctcttgctgtagctccttcgcaagatagtcagaaattttttttgtttgtccatcatttgttaaataaaatattgcagttttcatattatgttccctataacctattgtgaaaacgatcttaacaatttaaatttaaaagaactataatttgttttatatcaatccgttaattaaagtattttgattttatttagaatgaaaattaaaattcatctgagtattagctcaattactgttcacttataaaaggagtatatataatgaaatctatttttttacgtacagctttgttagcgtatatgtttgttgcactttctgctcaagctgcccctaaagagccttatactcaagccggatttaacacacgtttagcagagcaacagcaagccccaattcattgggtttctattgagcaaattaaagagagcttaaaaggcaaagccccgatgaatgtgagttttgatattgatgatactgtattagcaagtagcggttgcttctactatggtaagcagaagtattcgccgaatgattatagctatctcaaaaatcaagatttctgggacgaaatcaatgctggttgtgataaatactctattccgaaacaggtcgcccaagatctcattaatatgcatcaagagcgtggcgatcagattttctttatcacaggaagaactgcaggtaaggacgatcaagtcaccccgttacttgaaaaaacctttggcataaaaaatatgcaacctgttaattttatgggcggacacggtcaagataaattaaaaacaaaatacaataaagccgcagggattttaaaacataatattcagttacactacggcgatagcgatgatgatattctcgccgctaaagaggctggcattcgtggtattcgtgtattgcgtaccacaagttcaacttatacgccattccctcaggctggcggatatggagaggaagttattataaattcaagctactaataaatatccccgtcttaaaaggcggggatttgctattcccttatagcctttgaatactgttcaagtatagattgtacgaaataaattaacagaagaaggcatattgtctagatgagtgctatttttgttactccaattgtgcgatactgtttcgttagactaccccttccaaatataaaatgagaaaaactttctgaatttttaaaatgcaaacgtttgcgtaatccgttataatgccttcaattttgttttctatcattaacggaactgcccaatgactgtacaaacctttcgtggctcacctgccttatctgactttcgtttaaaccagcttcaacaaaaattcgagcaacatcaactgcctgttaaatcggtctatgccgaatatttgcattttgttgagctaaaccgaccgcttgtagccgatgaaacaaaaaaaatccaagagttgttgcattatggtccaacctttgcggaacacgagccaaccggcttttgtttgattgtaactccacgtattggcacgatttcttcgtggtcgtcaaaagcgacagatattgcccataactgtggcttatcagcggtaaaccgcattgagcgtggtttagcgtactatttcgagtttgaacaagcgttaaatgaagcagagttggcaaccctaaaaggcttgttgcacgaccgtatgttagaaaccgttttaaccgatgaaaaccaagcgagccaactgtttgcccagcacgaaccgaagccgtttacgacggtggatattttaaacggtggtcgcaaagccttagaagtggcaaacgtggaattaggtttggcgttggcagaagatgaaattgattatttggtggaaaatttcacggcgttaaaccgcaatccgcacgacattgagctttatatgttcgcacagacgaactcagagcattgccgccataaaattttcaacgcagactggacgattgacggcgaaaaacaagagaaatcgctgttcaaaatgattaaaaacaccttcgagaaaacgccagattatgtgctttctgcctataaagataatgcggcggtaatggaaggttctaaagtcggtcgttggttccctgatcaagacgggcaatatcgctatcatcaagaagatgcgcatattttaatgaaagtagaaacccacaaccacccgacagccatttcaccattcccaggagcagcgacaggttcaggcggcgaaatccgtgatgaaggggcgactggccgtggtgcaaaaccaaaagcaggtttgacaggcttctcggtgtctaacttggtgatcccaaactttgaacagccgtgggaaaatccgctttctaagccgaaccgtatcgcttctgcgttagatattatgatcgaaggcccacttggcggggcagcatttaacaatgaatttggtcgccctgcattacttggttattttcgtacctatgaagaaaaagtaaacagttttggtggtgaagaagttcgtggttatcacaagccgattatgctcgcaggcggtatcggtaacattcgtgccgaacacgttcaaaaaggcgaaattcctgttggggcgaaattaattgtacttggtggccctgcaatgaatatcggtttaggcggtggtgcggcttcgtcaatggcgtcaggcaaatctaaagaagatttagattttgcttccgttcaacgtgaaaacccagaaatggaacgccgttgccaagaagtgatcgaccgttgctggcagttaggcgatgagaacccgattttatttattcacgacgtgggtgctggcggtttatcgaacgcaatgccagaattagtccacgacggcgatcgtggcggtaagttcgatttacgcaaaattttgtgtgatgagaaaggaatgtcaccgcttgaaatttggtgtaacgagtcgcaagagcgttatgtgttagcggttgcggcggataaattgccattatttgaagcactttgccaacgtgagcgtgcgccttatgcagtgatcggcgaagcgaccgaagaaaaacatttaaccctgcacgacgatcattttgacaataacccgattgatttaccaatgaacgtgctacttggcaaaacgccgaaaatgcaccgtcaggtttcgtcaaaaaccgtgcaaaacccaccgcttgcacaggaagaaattcagcttaaagaagccttccaccgtgtgttacgcttgccagtagtcgcagaaaaaaccttcttaattactatcggcgaccgctcagtaaccgcaatggtagctcgcgatcagatggtcggcccgtggcaaattcctgttgccgactgtgccgtaaccaccgcaagtttagacagctatcacggtgaagcaatgtcaatgggcgaacgtgcgccagttgccttacttgacttcggggcatctgctcgcttagcagtagcagaaagcattaccaacattgctgcaaccaatattggcgatattaaacgcattaaactctcggcaaactggatgtcggcggcaggtcacacaggcgaagatgctggcttatatgaagcagtgaaagcagtgggcgaagagctttgccctacacttggcattactattcctgtgggtaaagactcaatgtcaatgcgtaccacttgggaagagaatggtgagcaaaaagcggtaactgcgccactttctctcgtaatttcggctttcgcccgtgtggaagatgtgcgtaaaaccgtgactccacaacttcgcaccgataaaggcacaactcgcttattgttactcgatttaggcgaaggcaaaaaccgcttaggtgcaacggcgttagcacaggtttacaaacaacttggcgataaacctgcggatgtggtgaatgtagaaaccttgaaaaacttcttcaatgcaatgcaagccttagttgctgatgataaattactcgcttaccacgatcgttcagacggtggcttaatcaccacccttgcggaaatggcgtttacaggcaactgtggcgtatcggctcacatcaccgcattaggcgacaacgatttagctgtattattcaacgaagaactcggtgccgttattcaaatcaaagagagcgacttaaatgcagtgcgtgatgtgttgaaagctcacaacttactacacattaccaaagacatcggctcagcaacggaaggcgatctgtttgaaattaccagtggtacacgcaaattactcagcgaaaaacgctctgaattgcgtggaatttgggcagaacttacacaccaaatgcaacgcttgcgagataaccctgaatgtgccgaccaagaatttgcaaccaaaaaagacccaaataacaaagggttatctgcattcttaacctatgatgtcaatgaagatattgctgcaccgtttatcaaccgtggcgtaaaaccaagcatcgctatcttgcgtgaacagggcgtaaacagccattacgaaatggcggcagccttcgaccgtgcaggcttcaatgcgattgatgtacatatgagcgacttaatggctggcagaagaaatcttaaagatttcaatgcgttagttgcttgtggtggcttctcttacggcgatgtacttggtgcaggcggtggctgggcgaaatcgatcctattcaacccaatgctacgcgatcaattcagccaattcttcgccaacccgaacactttagcccttggcgtgtgtaacggttgccaaatggtgtcaaacttggcagaaatcattccaggtacagaaaactggccacgcttcgtgcgtaataaatccgaacgttttgaagctcgtgtgggactggtgaaaatcaacgataccaactcactctggttcagcggaatggcaggctcacatatgccgattgccgtttcccacggtgaaggacaggtggaatttaagcggtcagatcagcttgaaaatctacaaaaacagaacttggttatcgcccaatacatcgacaacaacggcaacccaaccgaagtttacccagccaacccgaacggctcggtaaacggtattactgctatttctaatgtggacggaagagtggcgattatgatgccacaccctgaacgagtttatcgtgcagtgagcaactcttggtatccggaatactggagggaagatggggcgtggatgagattgtttagaaatgcgcgtgtggcattcaaataatctaattcttacgagttctatttagaaattttagattgttaattacaatgtaggagcttaatatgaaaaaattattagcaagtatttcttttattatttttatagtcggctgtacacctaaaccatcatataatcagctagctatgcaattacaaatggatatgtctaaacaagatgtgattagcttattagggcaaccaaataaagtatctgctagaaatacagataaagggcacgttgaagtgctaagctattgggggaaaacacttgtcggatttagtatgatagataatcagatgttatctcaagatagattatcagtaaccttattaaataataaagttacagaatggggagataaacttgatccagccgaaatgctggaaaaatcacaagaaatgacgagagagtcactggaaaagattcaaagtaatatcacaaacaaaaagtaatatccctttctccgatagctcctgtttttgacaagatctatcaaagtatagtagataaaatgattgctgatgaatattcttacaagcctttctattaaaaggtataatagacaaatctactgctaaaaagtggcttaaagccttatattacgggctttaagccactttgttgaattatgaaccaaaaaatgtcatttttgccacagtagcgacattcacaaacatggtataagaaataatattcaacgctataaatgtaatgcctgtaataaaacatttacccttaaaaagaaattaaatccaataagtatttggaatgattattcaataggaaaacaaacctatcaacaacttgctattaaatatcattgttcagtcggaacgattcaaagatatattgataaagcccctaaaacagcattaaatccaccactatcacgtgatttaaatattattgcggatactaccttctttggtcgtgaatttggtattttagtcctgatggattcgctttctaaaaaagtggtttaccatcgtgtcatcaaaacgggaaaagatgtttattacagaatagcgtttaattcacttcgtatgaaaggctataaaattcaatcaattgtctgtgatggtagacgtggcttgatgaaagatttatttaatacaccagtacaaatgtgtcaattttatatggtagcgatagtgatgcaaaaattaagaaaaaagcatcaatcacaagcgggtaaagaattaaaaataattgcaaaaacactcacaaaaagctcaaaaaatgaattttatcggcgattacactcttggttcataaaacaccaagcatttttaaaagaaaggagtgataaagcgaatgaaaaaggctattttccttataaacatcgcaatgtaagaagtgcttatgccagtttaaagcgttatatggattttatttttatctatgaaaaacatactgaattaaatatagaaaagacgacaaatcgctcagaggggctatttagtgaacttaaacgaaaattaaataatcataatggattaacgaaaaatcgtcagatattgtttatacaggattttttaaataaaaagagttgctaagaataattaaaaatattcattagtaaccactttgtcatataggcatagttttcacgaaattagcaaccattttgtctactatgcccctaaaattaagtaccgaatttatctaaacgactacatctaactcagattttagtttagaagcaatagcccttaataaatgattaagcattgtgtatctttttctatacattgagcgtttattactcggaatatcttcaaggttttttgactctaatgttaagggaagttcccaatattcctttaattcaccattactctctttaaaaatagtatcataatcaacaaaatagcgtgtgctttgaacaaagcgtgacttattctgatatttttgtggaatgccaaataatttagaataccctaagacctgagttaaagctttcatggcttcaaccattaaataggctggacgaagcccatggcattttttagttagttgtttgactaattctttagaaccttcaaagttcggaccttgaataactgcgataagtaatgcattttctaatttaccaaatgtcaataaataaactaactgaccgcttggtttatagcgtaattctaatgcccagaaaccctccattggttgatattcgttgacatttaaatagatttcaaaatcttcaattacttctgtaaaacatatagggctatcccataattgagggagatttttagataagagtactttaggtaaaaagtctaaattgtcacaaatcatgttaaaacgtctttgactattaaagcgtttatctaagaaacgatgaactaaaggatagctataatcggctcttttgattaataacggttttaacgaagattcagaattaattttatgttcaaatttctttatgagagatctatgtaatatagagcgaaaacgataacggaaacgttttaatctataagatttttttcctctatctggatagagatgagacggctcaggccatttataaactgtattgtgcataatgaaatgtgttttcgtgactaatagagccgttggagaatatcacctccaacggacagttattactatattacaacgcctcaatcgccttatactgcgcttgcaatttctcaagtccgtcttggtactcctgcattttttcacgctctttagcgatcacttgttctggggcttttgccacaaaggcttcgttgctgagtttgccttcgatacgtttaacttcgccttgaagtttttcgatctctttggttaaacgagcaagctcggcatctttgttgataaagcctgccattggtactaacacttccgcattacccaccaatttcgccacagaaagcggtgcttcttcgccttgagcaagcacttgtacgctgtctaacttcgccattgcttttaacaagcggtcgttttccgctaacattttacaatgttcgtcagataggttacgcactaagaaatccaagcctttgcttggggcgatgttacattctgcacgaatgttacgcactgccacaatcaactctttcaaccagttgatttgcatttccgccgcttcgtcaatttggttttcttccactttcgggaaaggttgtaacataatggtgtcgccttctacccctgcaaagcccttcactttctgccagatttcttccgtgatgaacggaatgatcggatgtgctaaacgtaataatttttccaacacacgcacaagggtttggcttgcaccacgtttttgtgcgtcagtaccgttagcaaacacaggtttggtgagttctaagtaccagtcacagaattggttccaagtgaactcataaatggtatttgccgctaagtcgaaacggtattggcttaacgcatcacggaactcgcctacggtgcggttgaaggtggattggatccaacgatccgccaagctgtattccacttcgcctgccgataagtctaatttatcgttagtgagtacgaaacggctcgcattccataatttgttacagaaattacgatagccttccaaacgtttcatatcccagttgatgtcacgcccgttgctcgctaatgccgctaaggtgaaacgcagtgcgtccgtaccgtgcggagcgataccgttctcgaattctttacgggtcgctttggcaattttttccgccaactgcggttgcatcatattgcccgtacgtttttcaagtagatcttcaaggctgataccgtcaatcatatcaatcgggtctaatacgttcccttttgatttcgacattttttgcccttgttcatcacggatcaagcccgttacatacacagttttgaacggcacttgcggtttgccgttttcatctttgatgaagtgcatcgtaaacataatcatacgagcaacccagaagaagatgatgtcaaagcctgtgattaacacatcggtcgggtgatacattttgagttctttcgtttgctccggccagcccaaggttgagaatgtccataagcctgatgagaaccaagtatctaacacgtcttcatcttgttttaacgcaacatcagcatttaactgatattttgaccgcacttccgcttcatcacgagccacataaacgttgccttccgcatcgtaccacgcaggaatgcggtgtccccaccataattggcgagaaatacaccagtcttgaatatcacgcatccaagagaaataaaggttttcatactgtttcggcacgaattggatttcgccgtcttccaccgctttggttgccacttcggcaagcggtttcacgctcacataccattggtctgtcagcatcggctcaatcggcacacccccacggtcgccgtaaggcacttttaagtcgtgcggtttgatttcatctaataaaccgagtgcttcaaagtctgccacgattttcttgcgtgccgcaaaacgctctaaaccttgataatccgctggaataagtgcggtgtaatttgtcaaaggtttaccgtctgagccgataatttccgcttccgcacgaatgtccgcatttaaggtcatcacgttcaccattggcaactgatgacgcttaccgacttcgtagtcgttgaagtcgtgagcaggagtaattttcaccacgcctgtaccgaactcacgatctacataatcgtccgcaataatcggaatttcacggtttgcaagcggtaggattacggttttaccgatcaaagactggtaacgttcatcttcagggtgaaccgccaccgccgtatcgcctaacatcgtttcaggacgagtggtcgctaccaccaaataatctttaccgtccgctgtttttgcaccgttggctaacggatagcggaaatgccatagcgagcctttgctctctttgttttccacttcaagatcggaaatcgccgtgtgtaatttcggatcccagtttaccaagcgtttgccacgataaatcaagccttcttcgtgtaaacgcacgaacacttcttttaccgcattggacaagccttcatccattgtgaaacgctcacgatcccagtcgattgagttaccaagtcgtctcatttgctggctgattgtgccgcccgaataagctttccaatcccagattttattgataaaggcttcacgcccataatcgtgacgggttttgccttcttccgccgcaattttgcgttccaccaccatttgggttgcaatccctgcgtggtcagtacccgcttgccatagggtgttattgccttccatacggttaaaacggattaaggtatccattaaggtttgctggaaagcgtgccccatatgcaaactccccgtcacatttggcggtggaattgcgatacagtaacttggaacattcgggttttcattcggcttaaaatagccttgttcttcccagtgtttataaagtgcttgttcgactgccgatgagtcgaaacgatctgccatttcgaatttttgggtcattgttgtctcttttttgatgtactaacttattatccaaagtattttctaagcgtttaactgctatatcatatatttctttatttttttcaaatcctataaaatgtctattcaattctcgagcagctaataaggtggatgcactaccagcaaaaggatctaaaacaatctgcttttctttagtgactagttccaccagtaatttcattaagtttaaaggtttttgggtgatatgatattttctatcttctgtggtcacctgtactttaaacatgtttgaatgatttaaagctcctcgctgaatattccaagatgttaatgcattttcattccaagctccaacttcattctctattaaattatctgctaaagtcccccctgttttatatggcttttgaaaccatagtattggttcaaatattggacgtaaatttgcaactctccaacctgcccatttttgctgattaaaagtatctcctcttttttcaaatacacaggaaattctttgggcacgatgtggtgccttatctctttcccaactaagcatatctttaaaagtaaacccactattttcaaaagcaacaataactctatgtgcaaattgtcttccagcgaaaataaagacagaactacctgattttagaactctataccattcattagaccaactttctacccattcttgatattcttgtggtcgtcttttgtctgcttcagaccaaccattaagaggttttcctcttcttttaaatagagatgtcttctgttgagctatggaactaccgcctaacgcactgttagtattagagtgtaacgtatcccaatcatcataatctatcccataaggaatatcagatatgattgaatgaatagaattacttttgatattttttatagcaattatcgaatcatcattatagatacaatctttcatcattctttattgcctcaacaaacccatcaatgatatctatctttgatgatatgtttatttcttttaataattcttcaatagcttcttctctagttaaagatttaattcttttaatttgcccttcccaataagacttttcatttatagatctattttcaataaatttaatttcattttggaataatttatgtaatgtttttttatctattttaaataacttcataaaatattcattaaaatctttcataaaattattctcagattctgccaccgatgtttttttactttgttttaatggaaaattccacaattgttcaaacgtaaaagaatctgtttcttttagatctaattgcaataaaataactaaatgttcccagctgaaaagtaatacattctcatctaatgattgtttaaatatttgactttgtgttgttggatattggaaaaagggggctgttaatacagcataatctttatcttctctccagtcacttaaagcctttactttaaaatctttttggttttttgctgtgcgacttagtctaaaagactttgcatcagcaactaagccatagttaaactctatagatagtgctgttacatcagcagcatttcctctttgttctaaaggtctagcatctaaattaagtaattgaagagctttggctaaaacaatatctccagctttagaaaataatttttcttgggttgagcttggttttattgattcaggtaatataccaatagctcttacaagagctattaactgatttttgtttaaagaataaataaagttagttagctcatcacttgcatctttaaatttagtagtacttaaactatcaattaaatttaataatttctgtaaaactgtgttttcttctattttcatatatttctcaacattatgtataaataagctacactgtagctcaaatcaaagtcctgaaaggactaacttatgcttgatctagtacggctttgccgtgctagggataaggcaaattttacttaccgacttcgttttcacttctgccaaatctcccctaacccctctttgctaaagaggggaactggctcaaacgaaaatataaaatcgaagtacttcaaaaagaggctcaatttttcagatgagcgattattttcttcgatctgatccccctctttagcaaagaggggttaggggagatttgtccaaactcaataacgaagcacaattttattttgtataccccaatattaacaactcgttcactaaatcctcacaccattgaggcaatttatctgctaatttagtaacagttttatttgctgaaataacaagctgtattttgggactatctgatgaattatcgtaaataaatgtttcatcatttaataaaattgcttgaattaaattttctcgactaatttgataacgtcttttaatcgtctcttcatcaataaaatgcccgcctgcttttactcttgctttgacacgagcaatatttatttttggatcatctactccaacataatttaaacgagtataaaaatttttcttcgctacttccattctttgcaaaatagatttacccgatagggttgattccattgaaaaagaaatattatgtcgtattgcaaatttaaatagctctattgcttttctacctgcctcaatatctgccaatcttggattgtcaggattaatttgcattgcaatatgatctgaatcaatcacaatttgcacggaatcccgattaaaagagcgtaatgtagatttacctgctccatttgttccgcagtagaaaatagcaagagacttattgtgcatattcaatcactcgaataaaaccatttgggtgatgctcaatcaaatccccattttctcgacgataggtcaaaacttctttctttttcttttccgctatccaagcagagaataaaacatcaagctctttttgtttttgtagaatttcgtctttcgtcattgttattctcctagcaaggcggtcaatttcatcatattactcacccttcaccatatccaaatgcggtatcccatcttccaaataaacctcagaaatcggtttaaacccaagcgattgataaaaatcttgcaagtaggcttgggcttgcacatagacgttttcactttgccattgttgctggcaaatggttaaggcttgtgccatcaattttttcgcaaatcctgttcctcgtgcttcttcggtaaccaacactctgccgatatgcacaccatcttgttcggggataatccgacagtaagcggtcagttttgccgaattttttgcaaaaaggtgcaaggctttccgatctttttcatcaacttcttgatacgcacaattttgttctacgacaaaaacagcgactcgagcttggtaaatttcaaacagttcttgggcagaaagttcggaaaatgcctttagttgccacatacgccttgtttcaatcctaagattactaaatcttcaaaatctgtttccatatctgcaacttggggaagttttccccaaatttcaaagcccattttattcagtaagcctaaactttgatcgttattgccgaacacaaaagctaataatgtatgcagttggtaattgggcatttgtttaattaagaaattcacacaggctttaccgatacctttgccatgaacagctttatcaagataaaaactgatttcgcgagagccgtcataagcagctcggctataaaattgcgagtagctatgatctgcccccaaaaagttagactgatttagttcaaggactgagttctgtattccacagggcttagtccttttaattttacttgaatacgctcatgattgtaataatgaatatattcgtgaatagcttgttccagttgctcaaaggtctcaaaccgtttaccaaagtaacattccgtttttaaacgcccaaagaaactttccattgcactgttatccaaacaatttccctttctcgacatactttgtacgattccactttgcttcaatatcgactgataacttaccatttgatattgccaaccttggtcagaatagagtatcggcgttgctccgtcaagccttgctacagcttgtttcatcattcggcttatctgctcgaaacttggatttcttgccacatcataagcaataatttcaccgttaaacaagtccttaatcggcgagagataaagtttaccttctgcacacttaaattcactcacatcggtgacccatttttgatttggggctgtagtgtgaaaattctgttttagcaaattctctgcaattttgccgacttcgccacgataagaatgatattttttgcgtttgtttttccctttcaacccaagctgttgcagtaagcgttggacttttttatggttaatcagctatatttttcttaattccagcgtaatacgatgataaccgtaattaccgtcatttttgtgataaattttgatgacttcttgcttaatcgctgcatttttattgtctttttcagcaagatgataaaagaacgcactccgttttaaatcaaccaattgcaataaaatctcaaacggaaattggtggcgtagttccttcacgaggtgtgattatactgattaatccaatatcttaatatggtttccttaacctgaaaatgctgacgagttaatgagcgatttttattatgttgaagataaaattcgatcacttgttgtttaaaagattgggtgtatttagccataaaaatttgcaccttaattagttggttgtttagtccaacttttggggtgcagatcatttttatctttatgataaatagtcattttttctaaatgttatttctatttcatttcaaataaggatattctcatgcaaaaatactttttattattcattcttctccatatggtgatgaacattttttcagcgcattacgtttagctttacaactacaagagcaacacaaaagtgcggttgaattaaagttattgctaatgtcagatgccgttagcgggggacttgctcatcaacagctggcagaaggttaccatttgcaacaaatgcttgaaattcttaccgcacaaggggctatggtcaaattatgtaaaacttgcactaatgcacgtggaattacctcattaccaccagctgaaggcgttgaaattggtacattagttgaattagctgattggacggtcaatgcagataaagtgttgaatttctagttgttatcctattcttaatgttaggaataaaaggcataacagacagtaggatgacagggcgaaagaagtatttcgccctttttattttatatttcctatttatgagagatgtgttgccctcttcatgttttgtacgaattgtgccaattcaagcaaacattgagggtgattgtcgaggtttcgttcaataatctgaactgtagcggaacccgagattgcgccggcagcccctaaacgcagcgcctctttaacttgttccggttttgcgataccaaaaccttgtaaaattggggcgctttgatattgggttaacccttcaataagaacatctaaattggcagcttgtgtttgattttctgcgctagtaacgccggctcttgagactaaataagtataacctcgagtatgttgagctaccgctttaattgtggattcattagcattaggtggacaaatgaaaaccggctgtacatcatgacgttgagcagcttggatatattcttctgcggcgagtaaaggaatatctgcaaccaatacggcatcaacgcccacttcggcacagcgtgcatagaatttatcaagagtttgcgcataaattaaattggcacaaagcaacagactaatcggtatgtccggataggttgaccgcactttggcaagtaactgaaaactttcttcggtgctacaacctgcattgagagcccgatcattggcagcctgaataactggtccgtccaacaagggatcagaaaagggaaagcctaattctaaggcatccgcgccattatcaactaaagtacaaataatctcaaaagagcgctcaaaatcagggtcacaaagtgtcacaaaaggaacaaatcccccttgttttttatcagctaattgagcaaataaacggctgaaacgagatgattgcacaatcatttgatagctccttttgcagttaaaattttatccaccgtgaaaatatccttatcaccacgaccggatagattcacaacaagtagttgtgtttttgttggatcttgcttgatgagttttaatgcgtaagccaaagcatgggagctttctaaagcaggaataataccttcatgttgtgctaaagcttgaaatgcctcaagtgcttcatcatctgtaatgctctcataatctgcacgaccaatagcatggagatgcgcgtgctgcgggccgacagaagggaagtctaaaccggctgaaatactataagactcttcaatttgcccgtctttggtttgcataatcggggatctcatcccaaaataaataccgactgaaccatgacgtaaaggcgcaccatgctcaccggtttcaatgcctttgcctgctggttcaatcccaattaggcgtacacttttttcttcaataaaatcggcaaacataccaatggcatttgatccgccgccgacggccgcaataaccgcatcaggtaagcgcccttccttctccaaaatttgccttttggtttcttctccaatcattttttggaattcacgcacgatggttggaaatgggtgcgggcctgcggcggtaccgagcagataatgtgttgtggcataatttgcagcccaatcccgcatagcctcacagcaagcatctttgagtgaacaagagcctttttgtacagggatcacttcggcgcccattaacttcattcggaaaacattaggcgattgacgttcaacatcttttgcgcccatataaatacggcaaggtatattgagcattgcacaggctaatgcagtcgcaacgccatgttgtcctgcaccggtttcagcaataatacgtgttttccccatgcgttttgctaagagaatttgccctaaaacttggttggttttatgggcgccaccatgcaataaatcctcacgttttaaataaagtgtagtgttcgtgccttttgttaaattacggcaacatgttaatgctgtagggcgaccggcgtaattttttaataaatcctgaaattcttgttggaaagcaggatcttctttcgcctccacaaaggctttttccagttcttgtaaaacaggtactaagatttcgggaacgaacataccgccgaactcaccgaaatagggattaagaatggttgtcatagcatttccttttacatttttatgataattttttaggtgtttgacgctccaaaattttgttaaacaccgctgctaatttttgtgggcttttcatgcccgttagactttctacgccggaattgagatcaagacctaagcaatgttgtgataaggcaagctcaatattgtccggattaatgccaccggcaaggagcagtttagatttatattcttgagggattttcgaccaatcaaaaggctgtccagtccctccacattgattgccgattttgctgtccaatatgtagcgatccacatggggaatcgacggaatttttaccgcacttttactttgtgttttggttgcaagggcggctaatgtaattttagggggcgcatcaactgaaattgctttccaaatttggcatgattgcggtaattgttggcgaagtgcggcaataaattcagccgtttcttcgccatgtaattgtactgcaaataaatcaagttggttgacgattttttcaataaaatcaataggttgattttgaaatacgccgacaaaacgcaagggagcctgtaccaccaactcttgagcttggcgtaatgaaagctgtcggggagaatgttctgcaaaaattaagcctccatacaatgcgccttgctcatacacggcttgtacatcctgcggacgagtaagtccacaaactttattttcgccaaaaattaaggtgcggacgctttgatggagatcgggacttcccatcaaactgctaccaataagaaaaccatgtacatcagatttcagctgttgaatttgatgatggtggtaaatacctgattcgctaataataattcggtctgccggaatttggcgtgcaagaggcagtgtacgagcaatatcgacagataaatcatgcaaatcacgattattgataccaataactttagcgccaagctcaatggctcgagttaattctgtttgatttgaagtttccgttaatattcccatgcctaatccatgtgcaatttctgccaatcgacgataggtttcatcatctaacacagaaagcattaataaaatcgcatctgcttgataatagcgcgccaaataaatttgatattcgctcacaataaaatctttgcacaaaattggttggttgacgagctggcgaacgcgcggaatataagtaaaatccccttgaaaatatttttcatctgtaagaacagaaattgcggaggcataacttttatacacctgtgcaatatcttctacattaaaattggctcgaatcaaaccttttgagggagaggcttttttacattcaagaatataagccggtttttgcgccgaaccttgctgaagtgcggtataaaaatcccgatcactaggttgaaggctatgttgaaacgcattcaaaggaaaatgggtttgttggtgttgaatccaaagtaatttatcctgtacgattgttttcaaaatactaggttgcgtgtggcgttgtggcatagtgaattccttttaataacgcgttaattgagataaaacattaacacttttaccagattggatgacatccaaaacctgttgtgcgttatgcttgatattctcataaccaaacaatttcatcaataatgccgtattcattgcaacggcttgggcatgttcaggtttgccttgaccttgtaacagtgcggttatcatttgggcattttctgcaggttcaccaccacgtaaagattccaatggtttggcttgaaaaccaaaatccaaaggagaaaggctgtagtaggtgattttcccatcatagatttccgctacatcagtccgtccatgaatagccacttcatccaatccacagccatgcacaacaaaagtatgtcgatgaccgagttgtgcaacggtttcggcataaggtttgagtaaatgaggagaataaacaccaagtagttgacgttttggtcgtgcagggttgataagcggccctagaatattgaagatagtccttgtttttagtgcttgacgcacagaaaccgcgtgtttaaacccgaggtggtattgctgggcaaaaagaaaacaaagcccgatttcatccaatgcccgtcttgcaatatccgctggcatattgatattgaccccaagtgcggttaataaatcgcttgagccggttttgcttgatacacttcgatttccatgttttgcgatttttaacccacaagcagctccaactattgcagaggcggtagaaatattaatggtattggcactatccccaccggtgccgacaatatcggcaaatgcataatcaggggtagggaagggttgtgccgcattaaggcatgctgccactgcaccacttatttcttcagcgctttccccgcgtatttttagcgtaattaacagcgcagtgagctgtattggatttaattccccttgaatgatggatgtgaaaagctgttgcatttccgaggatgttaaatgagtttgctcaataattttaagtaagagttgttctgtttgcatattatattccttgtgttctattaaaattcattaaatatgcgatagtttgtttcaataattgagatccctgtacagtcaaaatactctccggatggaattgaaaaccacaaatcggtaaagatttatggcgaattgccatgacgatattttcataagtggcattaacaattaactcatcaggcaactcaacgcccattaatgaatgatagcgagcaacaggcataggattattcaaaccttcaaacatagctaaattatcatgagaaattagcgataccttgccatgtaacacttcgccggcatgaacaattttgccaccaaaagattcaatcaaagcttgatgccccaagcaaataccaatcataggcactttgccttttaagcgcgcaattaatggcagtaaattgccggcttcagagggattacccggaccaggggataaggcaagtagggtattggggtgagctaaggtggcttgttctaacaacgctatatcacaatcgttacggtaaacttgaacctgatgacccaatgtccgaaattgatcgactaagttgtaggtaaaggaatcaaaattatctaaaaaaataatggttgccataataaaaaatccttatattgcactgtgagtctgaataatggcattaatcactgctttagctttatggcgggtttcatctgcctccatttgtggatcagaatctaacacttctccacaaccggcttgaatatgcgctatcccgttttgtacaaaagcagaacgaatcacgatacaggtatccaaattaccgtttgaggacaaataacccactgcgccaccataactatgtcgtttttgttgctcaacaaggtaaattaattgcatcgctttaatttttggcgcaccggttaaagttcccatattcatacaggcttgataagcatgcaacgcatccagttcagggcgcaattttcctacgacccgagaaaccaaatgcataatgtgcgaataacgatcgatttgcattaatgccttaacatggcgtgagccactttcacacacacgcgccacatcattacgagccaaatccaccaacattaaatgctccgcgagttctttcttatctaagcgtagctctaattctaagcgagcatccagatccagatcgatttgaccttgctcatcaaaacctcgcggtcttgaaccagcaatcggataaatttccacttggcgtgtttgtgcggaatatttcaaggcgctttccggtgaggctccaaataaagtaaacacctcatcttgcataaagaacatataagggcttggattggtttgttttagttgtcggtatgcccgaagaggatttggacaagctaaagaaaaacgtcttgatggtacaatttggaatacatccccaatatgaatatgatgtttaagtgaacggataatatctttaaatgcctcatcttctaaattcgtgcgaacttctgtggaggcgaggatgtgaggcaagtgcggttcaactttttgcaaattttggcaaatttgcaccgcactttgattcaagccatcggctgcctttggatgaaagcaaaaggtttgcaatgtcgctgacaaggtttgatgatcaataagtaataaattttcagccaaataaaagacataatcagggcaactcaaaccatcgtcttttaattgaatattttccataggaataaaattggtgactaaatcataagcaaataatccccctaagaaaatcggaatatcgctatgctgataaagcgttgttaagcaacgtaatccatcaaaaatcgacggggcgcttagcttactgtcttcatcaagatttgggtttggcaaagaaaacttcaccgaaagatgatgggtatcaaacgaacttatttcacaaataggctgtaattgttgtgcgatgtagggtaaaaccccttgcccatttaaggtcaatgcctcgaaatcaacttgttgtccttggcaagaaatttttaatgcggcatctactagcaacaaactttttaaactgtttttactttggatttcagcggactctaaaagcaaggtattttgtcggttttggcaaagtgtcgcaaaaatggcgatgggatcattacaataatccacatgatattctttggtttggataaaaacggactgcatttttaacatcctggcatttgttaattttgtactattaaactagtataaattaatattgtcaactttttttagaaataattattggatgaaggaaggattcaagagaatatgaagtaggttttgggatatttagagaagggcaaaatggggttttcattaaatcaaccccattttttcggtaatatgaccgcacttgaaaggaatgactattttaatcctttcactaagtaatgaatctgccatgttaaaagttgtttataagcctgaattcgcacccgttttttatcactcactggtttcaactcggtaactcaaagattgtcaggataaagtgcggttggattttgccaagaatattgcgtgagatgctcgccatcgctcaccccttcgctatcggcataaagcccttcgttataagcaaaagcatatttttcattgtcttgctccgccaacaaattgtgcccgcctaggttccaatattccgcatctgataagcttaaaccatataatgtaggcataatatccttgtgcgaaccaatgcggcttggatcaaatttaagggcaagtttgctctgtaattccgttggaacatgaacataaaacggtacgcccattgccataaaattctgttttggcgcatcgaaacgcacgctgcgcacgtggtgatctcctatagcagcaataatggttcgatttcccaccgcactttgcgccacttgtgtaataaattgccccaaggcgttattagcatattgataagtggaaagggatttgcgattttcttcttcactgccaaattttccttctagtacttgaggattaatacgctccgccttgtaatgttgaggtacttcataaggcggatgattcgtcatacttaatatatattgataaataaaggttcattactttctttcagtaattgttctgctaaggcaaaggcatattcatccgcaatgccccaataagacatggcaggttttgcatcaggaaaagtttcgataatatcattttggtcataacattcatccacaccttgcaacggcaaataattgcctaagttgtgccacattaaaccaccagatgtgataaacaccgtacgatagccttgttgtttataggttttaaatgggctatagggcggggcgatttgctgtgcagctgattggctgatattttgaatagggctataaaaaagcaacgatgccaaagttggcgcagtgccgttataatcagaggtaaagcgtttgaacacaaaatcttgttcaaagtgcgaccgtaattgtcccaataaatcattggtttcagggttatctaaaaccaaataattggtaccaaagctttccattaaggcaaatacaacatgaggtttgctttccttcaatgcaggattaacaggcgtacgctcaatcaggctatctgtgccaaagacttgttgcattaaggctttaccttcgtctaaatcaaccgcctcaaaaagaatattgcgtttacgatctctaaatgcccattccacagcaattacgccatttgggactagtttattgataacggctaaagaggaaacttgcgcatgatctttggttaatggtttggagcgtattgtaccgcgtacaaaaaatgccaaggcaaggaatgagccaacaaaaagcaaagttgcaacagaccaatgcacatcccaatttaacaatccttggtataatgcataatacataaagtacgcaggaagcgcagctaacacaagcactgcgagagatcctgaaataacagggtaatcatcatagatatttttcaacacggctttggtatcgtcttccactaaaccaaacataaacatatcgtaataattgttataggttttatagtaataaaaattacccgccacaataccaatgagcgcgatagcaaaaattaagatgtaaattgcccaaaaaagtgcggtggtttttgatctgcccccaaaaagttagactgatttagttcaaggactgaattctgtattccacagggcttagtccttttaatcttacttgaatacgctcatgattgtaataatgaatatattcgtgaatagcttgttccagttgctcaaaggtctcaaaccgtttaccaaagtaacattccgtttttaaacgcccaaagaaactttccattgcactgttatccaaacaatttccctttctcgacatactttgtacgatgccactttgcttcaatatcgactgataacttaccattttattgtctttttcagcaagatgataaaagaacgtactccgtttcaagccgagtaattgcaataaaatctcaaacggaaattggtggcgtagttccttcacgaggtgtgattatactgattaatccaatatcttaatatggtttccttaacctgaaaatgctgacgagttaatgaccgaattctattattttgaagataaaattcgatcacttgttgtttaaaagattgagtgtatttagccataaaaatttgcaccttaattagttggttgtttagtccaacttttggggtgcagatcaaaggggggaacatttaaattttacggtatttcgtatgctgtttcacggctttacgaatttgtcgagtactggtacgacgacgggcttttgtcacatcaaccttagtttccgtttcaggttttaagccaaccaattcacgcaagtagttcacttgctctaatcccatctcttcccaaccaccacgcggtaaacttttttcaagtttgatattgccgtaacgaatacgaatcaaacggctaacttgaatcccctgtgactcccataaacgacgaacttcacggttacgcccttcggttaaggtgacatcaaaccattggttaatccctgtaccgccaactgctttaatctgtttgaaattagcaggaccgtcttccaactgaacacctttgcgtaaacgttgtatcattgtgtcatttacttcgccaaatacacgcacagaatattcccgttcgacctctcgacttgggtgcattaaacggttagccagttcgccatcggtggtaaacagtaacaaacctgatgtgttaatatctaaacgccccaccgcaatccagcgagagcctgttaaacgtggtaagcggtcgaataccgtagctcttccttcaggatcagaacgagtacagagttcgccttcaggtttgtagtacatcaacactcggcagatctctttttgcgttggaattaggctgactaaattgccatcaatacggattttggtgcttgagctaacctgtacacgatcacctagcatcgcaattttaccgtctacacttactcgccctgccgcaatcacttcttcaatttcacggcgagagccttgtcctgcacgagctagaattttttgtagtttttcaccgacgattttgtcgtttgctttattttccgtttcaatggaagcggtcggtttcggcgatttttttacaagtggtttacgattttgggtttcttggcgtgtattacgctgagtcggtttttgcaacgtttttgcagaatctgaccgcttggttgcagttggtttacgaaatgtcgtcatttaagttccttatttgtcgctttcacaagcgtcggggtgttatttactatacttcccccgcttgagggggaagatgcccgaagggcagaagggggggagcgtataatccctctccctccgaaaatccttcggattttctccaccctatcccgcaagcgggagagggatattatgcttcaaaaggtgtcggatcgcccgaacccactcgaataatttcagggctatcttgagttaaatcgatcactgttgtcggtgattgccctaagtaaccaccgtgaataattaaatcaacgtgatgttctaaatgctctcgaatttcatcaggatccgattgggtaattgcttcatttggtaatattaatgaacacgaaagaatcggctcacccaaggcagaaatcagagccaaagcaattacattattcggcacacgaataccaatcgtcttacgtttagtcattaaacgacggggtacatctttagttgcaggcagaataaaggtataaggatttggcacattatttttaatcaagcggtaagattgatttgtcactagtgcataagtcgaaagctctgataaatcgctacatacgagcgtaaagttgtgattttcaggtaaacgacggattgccacaattctgtccattgcgtgcttatcgccaatcgcacaacctaaggcataaccagaatctgtcggatagacaatcacaccaccatttttgatgatttccactgcttgattaattaagcgttgttgtggattttcggggtgaatatagaaaaattggctcatactcttcctttaggttgtcaaaattggcgagattatacgctttttagctaagaagcggtaagattttatcaaaattctgataattacaatgcaaaaatgtgggagtcagattgctgacaaactatatattaaacagattgaatattgtagggtgggttttaacccaccaataaaatcaatatgttacgtttatatggtgggtcaagacccaccctacaagctactttgtcaataatctggagtgcattttgcgcttccgtgtttttgtaaaatatattttagcggtaatgaatttttaacaatttgaatgtgatcacagtttattttgagtgactcttataaaatctgaacgttatttcatgtaggaggcaattatggctgactcacgttatgcttcgttaaaaaaactgactaaatatcctctagcattagccagaaaacgtagggtgcttttctttctattctcgcttgtttttgctttttttatggcacagcttctttcagatccattatttaccccaactcaaagaaatgtgatgtttttactctttttgcgatttgtttatgggtaacgaaagctattccgccgttttcggtaggtattttaatcattggttttctcgtgttaattatgggaaggcacgatgcacaaaatgcaatgaaatatctacaaacctggtcagatagtgttatttggctctttctaggtggttttttccttgcggaagcgatgaaaaaaacagcgttagatacgttactgctaaaacatttattgcctaaatttggtacagaacctcgttatgtactttgaggcttaatgttgattacggcattaatgtcaatgtttatgagcaacacggctacaacggcgatgatgattgcaacgattagccctatttttgctacgctcgacaaaaaaagctaatctctccagggcattattaggtattccagccgctgcgtctattggtggaatgggaactatcattggctctccacctaatgctattgcatttagtacagggctaattcaacaatccgaatttagattagggggaatagttattggtttattaggccctgctttgagcattatatggggctggtttattattgagttgctttactaatcaatagaaaaaaactaaaaaggcagtcgctaaaataggaatgataacttagtgactgcatattttatttctgatgactaatttttcacagtatctagaataatgttttgtaattgctgcagcccatttaaccttgtacttgtcaaatggcgagttatctgcaaatcatcaaaaagcggttgaatttcaaaggattgcaatgcttcagctgatttttccgtaacaaaagcaatcaacaccactaacaatccttgcattaaacgagcgtcgctataaccttgtacttgacgtggctcaagctgaaaattaaaccataaacggctttcacaaccgtgaatttcttgccactgttcaagctgttgttcggttggtttgggtaattgacggcttagttgaattaacaagcggtatctttcttcccaagatttgcaaagggcaaactgggcattgatttcatcaaatgtcataaaatccctatccaagtatcggtaataaaagagctatatcatactgcgattttttgttaaaatcccccgacttttaccgatttgtaatgaggaacacaaaatggctgtaatccctatggtcgttgagcaaagctcaaaaggcgaacgtgcctatgatatttattcccgtctgttgaaagaacgtattattttcttaaatggcggtgttgaagatgaaatggcgaaattaattattgctcaaatgctctttttagaagcagaagatcctgaaaaggatatttatctttatattaattcgccaggtggtgtcgttaccgctggtttagcgatttacgatacgatgaactttattaaacccgatgtatctacgttgtgtatggggcaagcctgttcaatgggggcatttttattatctgctggggcaaaaggtaagcgttttgcattacctaactctcgtgtgatgatccaccaacctttaggcggttatcgtgggcaagcgacggatattcaaattcacgcacaagaaattttaaaattgaaagagatgctaacacacaaaatggcagaacattgttcacagccttttgagaaagtggctcaagatacggaacgtgataattttatgtctgcggaagaagcgaaagcctacggtttaattgatgacgttgtaacaaagagatagtgaataatggcaaattttgagaaagaaccacattgtagcttttgtgggaagcgtcgtaatgaagtcgatgcattaattgaaggtacagaagggcatatttgtaacgaatgtattgaagagtcttatgcgttaattaatggaacagatgaaccattgattgatgaaaatgaagctgagagccaagatgtgttaggcaatgtgcctaccccacacgaaattcacgcacatttggatgattatgtgatcggacaagaacacgctaaaaaggtattgtccgttgcggtctataaccactacaaacgcttacgcaatgcactgtctgacaataaagagagtgagggcgttgagttaggtaaaagtaacattttgcttatcggcccgacaggaagtggtaaaacattgttggcagaaaccttggcacgccgtttaaatgtgccttttgctgtggctgatgcaacaacactgacgcaggcaggttatgtgggtgaagatgttgaaaatgtgatccaaaaattgctgatgaagtgtgattttgataaagatcaggctgaacgtggcattatttttattgatgaaatcgacaaaattacccgtaaatcagaaaatccatcattgacccgtgatgtatcaggggaaggggttcagcaagcgttgctgaaattgattgaaggcactattgcgaatatcaatccacagggtggacgcaaacacccgaaacaagaaacaattccagtcgatacgtctaaaattctctttatctgcggtggtgcatttgctgggctagataaaattgtcgaagctcgaacaaatacacaaggtggcattggctttaaagcggaattgaagaaagataaagatcgtcaggcactcactgaattattcaaacaagttgagcctgaagatttggtgaaatttggtttaattccagagctaatcgggcgtttgcctgttatcacaccgcttgaagaacttgatgaaaaagcacttattaacattttgacagagccgaaaaatgcgattatcaagcagtatcaagctttgttcaaaatggaaggtgtggagttaaaattcaccaaagatgctttagtggcgattgctcaaaaagcgatttctcgcaaaacaggggcaagggggctacgttctatcgtggaaaacttgttactcgacacgatgtatgatttaccatcattgaaagcaagtaaagtgacagtgagtaaaaactgtgttgagaaaggtgaaaagcctaaggtggagtaacttaattgatattctccccgtcctaagggcgggaatttttactagaaacttttccactactgaatcaagttaactaatttggtataaccgaacacaaaatttggtaataaacttctccacatttacctaagtcattcacattcacacattcattcactttatgaatggtttggtttatggggccaaactcaaccacttctgcacccattaaggcgataaaacgcccgtctgatgtgccaccgccagtgtctaatttaggtgtaatttgtgttacgttttcgaccgcttgtatcgtggcttgaaccagttttccgttgtctgctaaaaacggttttcccgacaaattccattcaattcgatgctttaaaccgtattttcgcaacatttcggcaactttggttttgatgatttcatcatttacttcggtgcaataacgtaaattgaactgcacataaagctcgcctgggatcacgttattactgcccgtgccagctttgatattggcaatttgcaggcttgtcggtgggaaaaattcgttgccgttatcccattggtaagtagtcagttcgctcaaaaatggtaaagctgtatgaacggggttttcggctaaatggggataggcgatgtgtccttgaatgccttcaatataaaggttggcggtaatcgagccacggcgaccgtttttcaccacatctcccaactgtttggtgctggatggctcacccactacacaatagtggatcggctcttggcgttgcattagggtttccaccacttttactgtgccgtctttggcagcagcttcttcgtcagaagtgataagcaaggcaattttgccctgatggttcgggttgtttttcacaaaggtttcacaagcgattaccattgccgctaaagaacctttcatatccgctgctccacgcccgtaaagcatatcatcaacaatgtcagcggaaaacggcggataagtccattgactttcatcgccttcagggacaacgtcggtatgtccggcaaaggctaaacaaggttcaccttcaccgtgggttgcccataaatttaaggtgtcgccaaaaggcaaccattccaacttaaatccgaccgcttgtagtcgttcagcaatcagttgttggcagccttcatcattcgggctgatagatttacgttggataagagatcgactaagagagataatttgattttgcattttatttcactgtatttgctaaattattgaaaccttacaacaggtatatgcctatttttctttatgaagaaaattaagaggattcaaattttagcaataatcccccacaaagtcgaaaggctaataaagggaataaaaggcaatcgagtaagtttttgcttggtgaataaaaaatagatggcgtaaaacgttaaaccaaataaggacgcataaagcagtaataaaatcatctcatcaagagtaaacaaaggggataatgcaataaagagaagaatatctcctaagcctaagctctcttttttgtagattaactggctaagcagtgaaaataggctaaaaaagagaatggtgataaaaagtgaaaaaatatgggagtttagctcaagggaatgataaaaaagcagttgccataatgctaagataaaaataatcgaaacatagcgaatatccgttaaataatataaataatccaataaagataaatatattagacagataagaataaaaataagcggtaagttttcctcgtaaaatatccaaaccgtaataggaaataaaatataaaaaccgtaggataaaaatgtaaatttaggctgtaagctggatttatgtataaaatccgccaaacttaaaggcgattggactaataaatggtaatcctgataagtttgctgattaattcgtgttggaaaatgttgcatttctttttgaaaccaataagcaagtaaaatcgacaataaaaataacatcattctatcattgctcccatatcaaaaatcggcaaatacaaaccgactaaaatagttcctacaataattcccattaacaccattaacatcggctctaataattgggaaagtatatcaatttgataatctaaccgctgttgataaccgtcgctgatttgttgcaacattggcgataattttccgctctgctcgccaatggcaatcatctgtaacatatccgtaggaaagagttttggatctaaactgtcggctaaacgatagccttgttttaaataagttagtgtagttgctagagaaccttgtaataaaatatcatcacttttattggctaaaaaggaatgaagtacagtatctaaacgaatatgtgaagccagcattaaactgctattttgacaaaaaaagataatgcgtgaatactggataatgccttttaaaataggaatatggcttaatataataaactttaggcgtttaataagatctgtttttttatttaaaatatgaattaatagaaaacataatacacataaaataattagcgttaaaatagagtgttgtagaaaatgggataggctaaagagtatttcggtaattagagggagtgattttccttttgaaccataaagttctgcaaattgtggcacaataaaaagcaataataaaatagagagtgtgattgaaatagctaaaataaagacgggataaaagagaatttttttaattttcttggctaatttttccgatttttcacggcgttgtgcaatattggttaaaattagccctaaattaccgcttgtttctgccattttaattaattggatttcttgtggattaatatattttccctgttttttaaaggcaacggataacgcaaagccggcttcaatcaagcggattgtttcttgttgccaacggtaaaaagtgcgattttggcaggtttcaagcaacatcactaaactctgttttagggggattttagcttgaattaataaggctaactgttgcataaattgattaatttcttccttttttggtgcagtcggcaaggcaaaatgtcggctaatgcttaactggctgtatcctttttgttgcaaccgtttctctagcacttctcggctttcggcaagctgtcgccctgtctgcttttgcccaaagcggttgcgtcctttccattgaaattcataaatgttattcataacctaataccctatccacttcggtttcattggtgagttgttgttcaattttctgtttagcactctctcgtaggcaggaaaaatccaagtaagcggtctgtttatcgaatttttttgccgttctgcttaaacattggtaaaccccgatccgccctttatagccttgatagcattcgtcacagcctactccacgacactttttacagagcttacgcacaaggcgttgtgcaatcactaacagtagtgaattttggatttcatactcttgaatacccagttgcaacaagcgttcgaccgcagagagtgcgtcattggtatgcagggttgaaaggactaaatgccccgtctggcttgctcttaatgccatttttgcactctcttcatctcgaatttcacctagcataatgatgtcgggatcttggcgtagaaaggtgcgtaacagctggctaaaatcaaggttaatactttgattgacttgggtttgaattaagccgtcaatctcaatttccacgggatcttcggcggtgagaatatgtttatccatttggttgagatagtttaaggcgctgtaaagggtgatacttttgccactgcccgttggtcctgtcactaaaatcagcccttgcggttgtttcaaggcgttgagtagtgtggtctgctgttgtggattaaagccaagttgcagaaaatcaaaactggttggtttgtttttttgtaggcgcaataccagtttttcgccgtagatcgtcggcaggctagatacccgaaaatcaagggtgtccgccaaggcggtagtaaagctaaattgcccatcttgtggctggcgtaattcactaatatctagcttcgccagcagttttatccgtgaaataagtcggcttgccagttgaatagacaggcttttatacaggtgcaaaacaccgtcaatgcgtaggcgaataatcaatttttgcttgcgtggttcaatatgaatgtcggacgcattttgggctaaacagaatttaaaaagattatcgagcagttgaataatcggatcgcttaagttgagctgttcttgctcttgttctgcgaaagccagttcgctctcttcataaaggggttgttgctcaggcgagagtgcgttaagcaagtatttaagttcatcagaagcaatcaccacaggctcaatctgcttatgggtcataaaagcaaagatttcgcaagcggtgagattgttttcatcatcaacggcaagccataatttatgctcagtttcttgcacaggaacggcaaggtaacgcaataaaagctgtttctcctcgcaatttttttgccaacggctaggcgatatatcaaaaatgcgttcggtttgttgttcgcagatagtgtattgggacattgttaatccttggttatataggggtaggaaagtcccaccccatttgtttacggtgtagctttctgcccacaaaaattcgcagggaacaaactaatgtcagccccttgacagcttgttgcccaagtgatgttgttattagcaaatttcggggtcattgtgtagccgtagccatcaatattgcctttacctgccacggtgattacccccgaagcgacggaaatagatttaagatattttgcgtcagggacatcggatttatctgctcgaacgccatttttacctgaactacattccgagatttttttatcccctacgttataaatacaaatttccacatcggatttataagatgcggaagcacttaataactcagagagagctgccttttgggtgtaactggtgtaagacgggattgctattgttgctaaaatggcaatgatggcgatcacgatcattaactcaattaaggtaaaggcttttgcaagcggtcgaattaacctgatttttttcataaattgtccttctaaaatgaatgcgtaggatttacgccctatttactctgccactttttataaaaaatgcgacgagcaacatttattttttcgacgtagatcgaaaaaatcgttttttcttcctgtgcatttacacagtatttttgctaaaatagggcaaatttttgatttgagagtgaaagataaaatggcaaaagcaccaaaaaccgcttatgtatgtagtgattgtggcgcggaatatgctcgttggatggggcaatgtaaggcgtgtttagcgtggaacaccattagcgaagttcgactaatttcggcaaaagagagcaaaagtgaccgcttgagtggctatgcaggggaaacgacaggcaaaattcagcgattgtctgacattgatttgcaggaagtgccacgttttagcagtggtttttatgaactagaccgtgtgctggggggcggtattgtacccggcagtgcgattttgatcggcggacacccaggggcagggaaaagcaccttgctcttgcaagtgatgtgcggtttgtcgcaaagtgcgccaaccctttatgtgactggagaagagtcgttacaacaggtggcaatgcgagctaaccgtttgggcttgccgactgataatctgaaaatgttatctgaaacttcggtcgaacatatttgtaatcttgccgatcaggaaaaaccaaagctgatggtgattgactctattcaagtgatgcaccttgcggatattcaatcttcccctggcagtgtggctcaggtgcgtgaatgtgcggcatttttgacacgttatgccaaaacacgccaagtggcgattattatggttggtcacgtaacaaaagatggaactttagcaggccctaaagtgttagaacacgccattgacgcttcgttgttattggaaggggaggcggactctcgttatcgtaccttacgcagccagaaaaaccgttttggtgcagtgaacgaactgggtgtatttgcaatgacagagcagggcttaaaagaagtgaagaacccttcggcgatctttttaagccgtagtgaagaacagacttcaggcagctcggtgatggtattgtgggaaggcactcgtccgttgttggtagaaattcaggcattggtcgatcactcaatgcttgccaaccctcgccgtgttgcggtggggctagaacagaaccgcttatcgctgttacttgcggtgctacatcgacacggtggcttgcaaatgtctgatcaagatgtgtttgtgaatgtggtcggtggggtaaaagtcacggaaaccagtgccgacctagctttattgctggcattaatttcgagctttcgcaaccgtcctttaccgcaagatttggtggtctttggcgaagttggtttagcaggggaaatccgccctgtgccaagcggacaagagcgaattagtgaagcagcaaaacacggctttaaacgcgcgatcattcctcacggcaacgctccgaaaaaagcaattaagggaatggaagtctttaccgtgaagaaattaagtgatgcgttggatattgtgaatgatctataagcattaggaaaatgataggagctataattaaactcctatatgttctcccattctatacttcagacaatagtgatgctatcaagaactgatagcgttctgcctgcaccgcttgttttaaacgctctgcggttaaaatgctttttaattcggataatgctgtttggaaatcatcatttacaatcacataatcaaattcattgtagtggctcatttcagaaaccgcttcactcattcgttttgcaatggtttctgccgaatcttgcccacgaacaattaaacgtttttctaattctgcttttgacggtggtagaatgaaaatagttttgacatttggcactttttcacgaatttgtcttgccccttgccagtcaatatcaaggaacacatcaatcccttgctcaaggctacgttcaatcattggcaatgatgtaccgtaatagttaccaaaaacttccgcccattctaagaaatgtccttgttcaatcaggcgtttaaattcatcgtgttgcgtgaagtaataatgtacgccgtgttcttcacctggacgtggattgcgtgtggtgtgggaaatggaaagttgtacttgtgaacgaggaagatccgaaagtaacgcattgattaatgatgattttcctgcaccacttggggctgagatgatatataaatttcctaagctcataatttatttagtgttgttctcacaatggtcttgaatgtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcgattttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttggcgttattggtttcggttttggtctttttctgatgggaaaaaccaatcacgaaattgcgtttagcaacatcaataccacaataaatcggagcgttcatcggtaacctgccttgtattcgggtttatatttcaactgttcggttttgctgatgaagttatccacgcctacgctacagaacgagttttagctctagggacacccaagctgtggataacgttatggtttatgttgctagtttactataattttaatatacaagggacacactgcgtgtgtccgagatcattgacaaagtagcttgtagggtgggtcttgacccaccatataaccgtaacatattgattttattggtgggttaaaacccaccctacaatattcaatccatctaatatatggtttgtcagcagcctgggacacacgcagtgtgtccctacgattatttatgtaaataatagcgtaaaaaattaaggacgcaaaagcgtccctaacactgaattttattttttcgcaaggggtggaacaaaggtaatacctaaatcccaaggttgctcaatccacgtttcttgtggaatatcaaccacataatcatctactaactctgcccccattggtttagcaaacacggtgacaaattttgcattcgggtacatttcacgaatagcacgagcagtattccctgtatccactaaatcatcaacaacgataaaaccttcaccaccatttgccacttgtgcagcgtgtaacacttttaattcaccttgatgatcgtggtcgtaacttgcgatacacacagtttcgacgtggcgaatacttaattcacgagccaatacagcagcagggaataaaccaccacgactgacggcaataatgcctttccattgtgatgcaggtaaaagacgttcagctaatttgcgtgcgtgcatatgaaacatatcccacgtcacgacatatttttcatttgtgtatttctcactcataagttcacctaaaaaaagcggtggcgatgccaccgaataaaaaaattgcgaaatgataacctgaaaacaactttcgtgctatcatttcaaggcaaattttacaataaacttatttatccgaatgaattttgcaaaattttacaggaaactcaccgctattattgtttataggaaatcgatatgtcagaaattcaaacacttaaacctcacttattatggaaatggtttgatcaaatctgtgccattccacacccctcttatcacgaagaagaaatcgctcaatttgttgtgaactgggcaaagcagaaacagctttttgtagaacgtgatgaagctggcaatgttttaattcgcaaacctgcaacaaaaggaatggaagatcgtaaaacggtggcattgcaagcccatttagatatggtgccacaagcaaatgaaggaacattgcacgatttcaaaaaagatcctattcaaccttatattgacggcgaatgggtcaaggcaaaaggcacgacacttggggcggataacgggatcggtttagcctcttgtttggcggtgttagacgctgatgatcttgttcaccctgaaatcgaagccttgctcacaatgacagaagaggctggtatggaaggggttttaggcttacgtccaaattggctgaaagcggacattttgattaatacggataccgaagataacggtgaaatttacattggttgtgcaggtggcgaagatgcgaccttaatcttgcctgtgaactatgaacaaaatccttttgatacaaccttacagataagtctaaaaggcttaaatggcggacattcaggctgtgacattcatacaacaagagctaatgccattaaactaatagctcgtacgttggctgagttaaaatcgcattttgattttcaaatcggtgcaattcgtggtggctccgtgcgtaatgcaattcctagagaagcggtcgtttccattggctttaatgcaaaagatcaagacaatctgaccgcttatttgcgtcagtttgaacaggcattgcaacgtgagttagcttttgctgaacctaatttacattttattgtggaaaaggttgccaagccgtcacagatttttgccaaagagagcagtgagaaagtcattcagttcctcaacgtgctaccaaacggcgtaattcgcaatagcgatgtggtcgaaaatgtggtagaaacttcattgagcattggcattttgactagcgatgaacaaggggtaaaagcgaatattttagtgcgttcattaattgaaaacggcaaagcagacgtacgttctcgtttaacttcattggcagaactggtcggtgcaatagccactttctctggtggttatccaggttgggaaccagacccaacatccgccattacgccacttaccaaagcgatttatgatgaaatactgggctatgaatctcaaattaaagtgattcacgcaggcctagagtgtggcttgattaagaaagtctatccaaacattgatgtggtttctattggcccaacaatccgtaatgcccattctccagatgaaaaagtgcatattcctgctgttgaaatttattgggaattattgacgagaatattggggcaagcgccaaacaagtaaggaggtattttcttcccatccaaaaggatgggaagaagcctacttaattaaagcgttttaaatttaattttttaattaaaaaattaagtactaggccatagagcggtaaaaagagcaacagactgacaaacaatttgaatgcataatcaactgctccaatagtaaaccagtgttccgccatatattcatcactacttttataaaatgccactgcaaagaacacaaatgtatcaattaaactaccgaaaatcgttgagcttgcaggggcaagccaccacgttttgccttgacgcaagcggttaaagacaaaaatatccattaattgacccaccacataacctgcaaaacttgctaatgcaatacggaaaacaaatagattgaactccgccaatgtagctactccctgaaattgcccctcaaagaaaatcaccgagatcacatagctaacgatcaatgctggcaacattaccgctaaaataatttttctagcaagtgacgcaccaaatacacgaaccgttaaatccgttgctaaaaagataaacggaaaggtaaaagtcccccaagttgttgggatcgtcgtttgagtaaaagggattggaatttcaaacgcaatctgtactaaatagttactgattgtgatgataaatatgtgaaaaagagaaagtaatagcaacgagcgacgcttctgctcgtcagaaaagtaatcaaatacgttcatattgttcctttttatataagtttggttgtttggggtgagggaacccaagtgaaaaaagaggacgtatgatacgctttaaaaagaaaagatcaagtaaatttacgatgatctatattaagaaaatttatgtaggggtaaggttttccccgcccctacaaaaaattaaatgtttatgcaattgctacataatattgaaatttttgcaatgatttcaccgcttacacagcctattgagtcaagagttccaaagcctcttgatacttcgccaccgttttttcaatcacatcagcaggcacacgaggggctggagcctgtttgttccaaccactctgctctaaccaatcacgaataaactgtttatcaaaagacgggggattacttccttcttgataggtttcaactgaccaaaaacggctagagtcaggggtcaaaacttcgtccatcaatgttaatacgccattttcatctaaaccaaattcaaatttagtatcacaaataatgatccctttagttaaagcataatctgccgcttctttataaagtgctatggctgcatctcgtacttttgccgctagctctaccccaatctgacgctcacattcagcgtagctgatattaatatcgtggtcgccaacttccgctttacttgaaggggtaaaaattggctcaggtaacttgcttgcttcaaccaaaccttcgggcaatgccaaaccacaaatagtccctgttttttgataatcttttaaaccactacccgtcaaatagccacgcacaatagattcaatttttactgggactaaccgcttacaaacaacggcacgatgttgaatagcttctgcttctgctcgtggtagcacgtcaaaaacagaatctcccgtaaaatggttcggcataatatgggctaatttattgaaccaaaaattagaaatttgcgtcaggatttcccctttacgagggattggatcatctaagatgacatcaaaagcagacaagcggtcggttgcgaccattaacatgcgtttatcatcaatttcgtagagatcacgaactttaccagaatagattttttttaggctgatttgcataacaaagttccaatatctaaacaaagaatagaataattatatcgacttacgcaaacgtttgccatgagaaaaaaaataaatttttcgatctctgtcgaaaaattaaaagaatccaattgcagcaatcacaaaatttttttactttatgacaactttatatttacaaatggagtacgcaatgtctcttacctatttatttgaacacagtcagctattactcattattgctagtgccatactcatctttgcttttggaataaccatatctaatagccggaaaagaacgacattatctaggagagctactattgatactccgatattcccaaaaggctttacacatagttccaacttagcaatagttgctaagtcgagttaccataaagtcccattaatgaacaaaagtgaacatcgtttattctatcttttattaaattacctaaaatcacacaaccttgattcacattttcttctattttctcaagtcgccatgggggagtttatcaaagcggaacaggatgaagcctatgcaaaaattaatcacaaaagggttgattttcttatcacagataaacaaagcaatcctattgcagtcatcgaatatcaagggcacgctcattatcaacataatgcagcggaaagagatgcaataaaaagggaggcttgtcgtaaagctaatatcgcatttatagaaatcacgccaaactataatcaagttgaatttaatattatcttaaagatattgcaaagattttctaaatagaaaggaaaaagagtaaataatggaatagaaaaaactttttatctagaaaagaagatgggtgatagatgtaggtcttatcatggagcgggaaacgaggctcgaactcgcgaccccgaccttggcaaggtcgtgctctaccaactgagctattcccgcaaatatgatgaataaaaatggtgcccgaggccagacttgaactggcacgcctcgaaaggcgagggattttaaatcccttgcgtctaccgattccgccactcgggcataacgaaaaaatggagcgggaaacgaggctcgaactcgcgaccccgaccttggcaaggtcgtgctctaccaactgagctattcccgcaaacatgatgaataaaaatggtgcccgaggccagacttgaactggcacgcctcgaaaggcgagggattttaaatcccttgcgtctaccgattccgccactcgggcataacaaaaaaatggagcgggaaacgaggctcgaactcgcgaccccgaccttggcaaggtcgtgctctaccaactgagctattcccgcagcattgcttaacacaacatattcgttgcggcgtattttagagatttttatatgcttgtcaaacacaaatcagcgattttctattgttcgatgattttttaggaaattattgcacactttttcaaatatcctaccttccaatcatttatataaagagaaataataaagtctgaagatagcaaaaatttttccaactacacagaaaacggatactgaatactcggatgatattcgtagctctcgacttcaaaatccgccaaggttacccaagtttctaaatcttctagggatttaatatcggggttgattttgagtgttggagctttaaatggcgtgcgtttcagttgcacatctcgcattaattccagctgatcttcataaatatgagcattcacaattttatggaacgcttgtcctgcttggagtcctgtaatttgtgccattaacgcaagaaaagtgtaacattggatcatattccagtttaaaccgagcggaacatcggcagatcgttgggtactgttcaaataaagcgtgccatccagcaatgaaaaatgatgactgtgtaaacacgggcgtaggcagcccatatggaaagcccctgggtgatagaacgtataaatctcaccacgattatcgacaccacgcttcagatcatcgacaatttgacgtaataaatcgacgctaccaccgccaactttcgggaagtttcgcccgaccgcaccataaaccagccccatatcatcttcgcctttgcgatgtgggtttgccagccaagctgcattttcattggcatttgcgtcccacgattttgtgccaagctgacggaaatctgcagcattatcataaccacggatataaccgagtaattccgcaattgccgctttccagaaacttttgcgtgtagtcacaaggggaaatgcaccctttgccacatcataggttaaatcggcgttaatcacggttaaacaacgcttacccgtacgttcattttcaacccacttcccttgttcgacaatacgttggcagagatcaagatattgtttcataattcaaccttaaaatgtttagagtaatccgcaaaataatttgttagaattgtaacacttttttagtacagagagataaggagtaaatgatgaaatctttatacaaacgagttgctgtcatttttacgttgatattggtaacagcttgtagcactaatacaagcggttggaagcgtttacccgagtcccaaatcgatcaaaaatcctatgcgattgcttatggtgcaacagggcaaacttatgcagatcgcgtaaatgaaagctatgatattacatcttttatccgtggggttgatgattggtttaacaagaaagttaagcacccgatagaacaaattcgggcaagcctgttaaatcgaatgttagatcataatgtgtatgcttattatagcggcgtactttatgctgccgatctacaaaataattttaatcgtctaagcccaacctgctggacaatggttcaaacaccaagcattacacagggtatctatgatgcaatgttagatattcaagccaataaagtccgtcacgataaatatatccaagaaggtgcggatcaaattcttcacttatgtgtagaacaaatggaaaatgaagcccagaaaaggaaatagtgaatctattttcactcaatataattatgtctgacgatttctttattttccccctaagcgggggaagataaagaaaaaggatgggtggaatatcaaagataaacgctatagtaggagggaatataaactcatctcactaatagcaggtcaaatccgaaggctatctaactgccttaaacccagctttcgcaaaagcctctttcgcttttggtgtcgctaaaaagtctaagaaacgttttgcttcaggcttatcgcttaaggttgccgcaggataaaccaccttgccataactctcttgagggaaaaccgcgacaactttcaccttatcactcactttcgcatcggttgaatacacaatccccaacggcaactcaccacgctcaatataagaaagcaccgctcgcacatcttttgccttagacaaacgaggctcaacctcagcccaaacgcctaaatgttctaacgctttcttcgcatagcgaccaacaggcacattatcatcgcccactgccaaatagctatctccgatcacctttttaaagttaatatccttaatagacgccactttaattttactgtctgcaggcgcaatcagcaccaactcattttcaaccaacgttgtcacattttttgttttggcaggcagcttctcagccacataatccatccatttttgatccgcagacacaaacaaatccgcaggggcatcttgctcaatctgttttgctaaagttgaagaccccgcaaaagaaaaggtcaaactatcctctggataagtttttttatactcatcaccaatctgttgcaacacatttgtcatagacgctgccgcaaataccgtaatattttcagcaaacgcagaagtagcccccaaagccaatgctgacgctaaagctaattttacaaacgtttttttcataaataatccttatgagagtggatataacaatatataaactattatataacgaattataaaataaatacaaaggtaaaaattacatttccttttaatacaagaaagtagataatttcagcgttctattttgcaaaaaggcagcctatgttaaacaacgaaatcctattaaccatcaaactaaaacaacagctttttgtcgatcccaaacgaattaccctactcaaagccattcaagaatgtggctcaataaaccaagcggcaaaaaacgccaaagtcagctacaaaagtgcttgggatcatcttgaggcgatgaacaacatcagccctaaaccacttctcgaacgcaacacaggaggcaaacacggcggcggcactgccctaaccccttatgccgagcggttacttcagctctacgatttacttgaacagacccaagcaaaagcctttgcgatccttcaagatgaaagcatccccctagatagcttactcactgcaacagctaaattctccctacaaagcagtgccagaaaccaattttttggcactgtcacccaattgagagaagaagatgttcactgctacgttgatattcacattgcagaatttccgcaagatctcaccgcttccattacagctcaaagtgcaaaacggctcaaactaacacaagggaaagaggtaatgttaatggtcaaagcgccgtggattgaaattcaccccgaacacccacaacgctcaaacagcctagcagccaaagtcgaagcaatttacgacaaaggggaatataaagaaattgcattaaacgcaaatggaacggaatgttacgcaacggtcaaaaaagctcaaccgctccaagaaaatcaacaggtatggatacatatcgatcctgaacagatagtcttagttactatctaatccctctacgggcacactcttcggtgataaattttttaacatcccactatttttttatggaatttatggcacaatacacgcctttttgaaaaccattattattttaagggatataacaatgaaaaaatttcttgctctatttttagtcggtggtgttgcagcgttggcggttcactattttcaaggtgataaagccacagcaacagaaacggcaaagccgactgaaccgacaactcaaacaaagcaaaatgatgaacttgctctggcaacggtggttgccccttgggaaatcaatagccttgatccgaaccagacaggggtgatttttcaacgtatgaatttagcggaaaccttagtagaagcgaatttacagggggaacttgttgcaggattggctaccgagtggaacagcaatgaagatgcgaccctttggacttttaaactccgtccgaatgtgattttccacaatgggcaacctttgactgcacaagcggtggcaaacagcctaaatattgcattggcgaaaccgggaatgttgcaaaaagcctttattaaagatattcaagcggtcagcctgacagaaattcaaattgccttaaccaaatcttttgtgccgtttccatcttttttaacgcactacaccgcaattattcttgcccctgaaagctataacgacaaaggggaagtgaccaaagtgatcggcacgggggcgtttaaagcgactaaaattgaagcaccacaaaaattggaagcggtgcgttttgaacagtattggggtaataaaccgaaactggctcaagcgaactaccttgcaagtagccgtagtgaaacccgaatgctgatggcacaaagcgataaatctgccttagtgtttaaccttgataccgccagtgttgagcgtttgaaaaccgatccgaatttgaacttaaccagtgtgtctattgctcgtactattcagctcaaaatggacgtggaaaaaccattcttcaatgatttagcggtgcgtaaagccttaagtgaagcgattgatcgcaaagcaattgcggaatatgtgttaaaaatcgaaggtggcgaggcggatcaaattctgccgaaagcctttgcagaatggcgaattgatacgacaacagcaaaacctgatcttgcaaaaatcaaagcagatctgaccgctcgcggttatgaatttaatagcgaaggcaagctaactaaagacggtaagccgtttagttttaccctacgcacattctccgatcgccctgaattaccgatgattgcgacaattttgcaagctcaatggaagcagattggcgttgatgtgaatgtgtctgtcggtaacttcagtgaaatccctgctgggcaccaagacggcagtttagagatggcgctttatgcgttaaattatggcaaaaccttagatccttttggcgtgatcgtgcaggattatgcgaaaacaggaagtgattggggggtaatgaattggcaaaatgcgacgttagacaacgctttaactcagcttgaaacagaacgtgatccacaaaaagcgaaggcgttaaaacagacagtgagccaaattatccacgatgaactgccgattattcctgtggtgtactatcagcaaaatgtggtggcacataaagacgtgaaaaatgtgactttagatccttttgaaagacggttctttttggagttactaacaaaataaacctaattaatttccccctttgaaaaagggggattaagggggattttaaaaatgcaaattctcacactgattgattaaaaatcccccctagcccccctttttcaaaggggggaatttcctacaaatttttataaaacaggatccccgtgctttctattttattcagacgactatcccaaatccttttggtgatttggtcagtcgggactttgacttttattttaactcggcaactgtcgggcgatatggcatatcgtattgcggcaagtcgctacggttatgatcaaaccgatgccgccgccgcagaaatggtacgagcagaactcgggttggatcaaccttggtggcaaacctacggcagttggttagcggatttagtgcagtttaacttaggtaaatccttagtcacaggcgacagcgtttggcacgaaattgaacatcaattcgggcatacctttagtctagcggtggtagcgttactgttagccttgctcattggtcccatcttaggcgtattatcagctcgtaaaccgaacggcgtatttgaccgcttgaccttagtcttaagcagtttatttcgtgccgtgcctgcttttatcattgcgattgggttgattacgcttttttccgttcagttgaaatggttaccagcaggcggatacggcacggcattgcattttgtcttgccagcactcaccttagcgataggtttaagtgccgtttcggtgcgtgtgacacgtcaagcgatggtgcaggtgatgcaatccgactactatcaatttgcacagctaaaaggcttgagccgttggcagacctttgtgcgacacgggatcccgaatattgccgtgccagtgattgcttatcatagcgtgcaactggtttacctgattgaaggggtggtgattgtcgaaagcctttttgcttggccgggaagcggacacgctttagttcacgccatcattgcacgagatgtgccgatgatacaaggcacggcgttagtgatggggggattctttgtggtactcaatatgcttgccgatctgcttaatgcgtggattgatccgcgtattcgtgaagggggaacagtatgaaattaaccgttggacaacgttgcggagctttgttattactactgctactcaccactgcatttttacagccttatttctacccgatggatattggttttcaagatctcagcaatatgttggcaagtcctgatgcagaaagctggtttggcaccgatcatttagggcgagatatgtttgcccgtcttgcctccgccattcgactttcatttggtttatcgctgtttagcgtcacttgtgcattggtggcaggcttgttattcggtattctggctggattatttggcggttggttagatcgcctgtttagctttatctgcgatttggtgatggcattaccgggcttattgctgattttgttgtttgcttcgctctcccctggttcattttggacactctatttgggcattgccttggtgatttgggttgaatttttccgtgttattagggcgatcaccagtactcttgcgtccagctcagaactgcaatcttctcgtttgatgggaatgccttggttttattgcattaaacgtcacctgttcccgcgtttattgccgatggttgccacattaaccgcattttcaatcggtaatgcgattttagcccttgcgacactcggatttgtcagtgtgggattgcgaccacctacggctgaattgggactgatgatgacggagctgttcccctattactatcaagccccattgattttcctacaacctgtaattgctgtgttcctattggtatttagcttgcagttgttggcggggaaggtgaagtaaatttgaacattaactatcgtgcatatttccttctctatcaaaatacttcccccatttatgggggaagtccccaagcgacagcgagggggatgggggaaaaggggaataaagctaaatgtaaatagcccccatcctcccttcgggcaccttcccccacaagtgggggaagaatcaaacgtagcatagtacgaaggttaatgtaaaatccattgaaatatagtagagaaaacaccgtgtcattactcaaaataaccaacgtcactgttcaaacactcgatggcattgagctagtcgaaccgatcagcttttgtcttgaacgtggcaaaaacatctccattttaggcgaaactggttcaggaaaaagcctgttaattcaagcaattatgggggcgttaccgcaaggcttaaccgcaagcggtgagattgtggtggaaaattgcaaaataaacgggcaatccgaccgcttgcaatctctttggggcaaaaccttagtgatgctaccccaagagccacgccgttcattaaatccactgatgcgaattagccgacaactgtgggaaagttttcgttttgtcgctgggttaagccaaaagaacgcagaaaaggcgagcgagatttctttaactcaactgggtttatctcaagctcaacaacgctatccacaccaactttcaggtggtatggcacagagagcttcctttgcgatagcgaccgcatcaggggggaaaattctacttgccgatgaacccaccaaaggacttgatccgaatagcaaagcggaagtgattaacttgctgaaacaagcctatgaaacaggcggtagcttgctgacgatcactcacgatattgaagtggcgaccgctctcggtggctatatttttgttatgaaaaaaggcaaattgatcgaacaaggcgaagcggaacaactgctgagccaaccgcaagatccttatactcaagccttaatcggtgcagatccgcaacattggcaacctttggctgatttgcaacattctacgtcaaaaacaccgcttgtttctgtcaaaaatttaacggtcgcacggggaacaagaacgctgttcaaacagctttccttcgatttacaccaaggcgaaattttaggcattgtcggatacagtggcataggcaaaagcacccttgccgacgtactttgcggactacttaaaccgcaatcgggcgaagtgatttggcatagccacagccataaaaaacatcaagtgctgaaattgtatcaagatccgcccgaagcctttgcaccgaatgtgagcttgcaacaactattggacgatgtgatcgagcatcatcatctcgaccgttcacaaattccagctctattagcacagcttgcattgtcgcctgacattctgcaacgcaacgccgataacgtatcgggtggcgagttgcaacgggttgcaattttacgagccttgctacttgaaccagtgctactatttgccgatgaagtgacttctcgcttagatccgatcactcaacaagaaacgatcaaattgctgattgagcaatgccgagcgagaaattgcggattaattatcgtcagccacgatccgtttttgattgaacgaagttgtgataaggtgattgatcttgaaaattatctttaattaataaaaaagcagaaagggacatttacagaatgtaatattcaaataactcagaaatatgctcattcaaactatttacaccagcgatattctcgccttgccaagccatttgcaatatctctggggacagtaatcgttcatattgttccgaaatagggaaatagctcatatgccatggttctagaccaataaacttattattagcttccataaaagggaaataaaaaccaaaacgttcggcattgactaataaccaattcgttaaatgttgaaaatagcctcctgtctgatattcccacggttccaacatgagcttttttccttcaggaagtaaagtaggatcaaaaatatcaatttctgttccccaatggtgacggctagcccctggcactgcggaccaacgcaggatagcttgacatttgtcccaatcatctaagccagttaatatgatagctttaccatgatcatcatgaactttattttcaccattgaattttgtattccaaatccatttttgtcgttcaaaatcccgataagtacttgcaggttgtaaattaaaacctgctttcagtgcggcatcttgtaaatgcaaaaatgcttttactacttcagattgtaatgcatgctgatcagataatttatttggtaaggcaaccaaatgctgtctgctctttcctgtaagaagagaaggtaaattttcaaaatttaacatgaattaaaccacttcaaaaaaacatgggaaaccgtattatagcaaaagaaaatacaataaataaaacaccacatctctaccaatatcccttataaaacaatgcattctgcaccaccttcatataatgagggttatgtgaagatcaaattcccagcgacaacaggggcaaacccaattgttgaaggggataaagtgaccatcaactacaccccagaaaatactgatggaacagcgggtacaccgacgacattgacttacacctatactggcggaaaatgggttcaagatgaaaaagattcacttaaacttgagccaaccaatgaaagcggtaaatgggtagtgaaactcccagaagacaaagtagcagataaaacatctgtcagtgcaaccacgactgatgtagcaggacgcacatctgcagaaagtgaaaccagcaggaaagatgctccgtttgatgtgaaatcagataagccagtgattacctcaatcaaggcgattgatacatcagcaacggcagacaaagatcctgagcgagtcatcattgaaggaacaagcacagaagcagatggaaccaaagtttacctctacaaagaaggtcaaactaacggacaaccaattgcagaaacaacggtaacaagcggtaagttcaagtttgatattagcgaatctacagcaactccattagccgttggggataaatttgttgccacagtacaaacaaaacgctgcagaaactaaagaactgaacaaaggacctacagacgcaacagccaatgagcctgaatacagcaaagttcgcacagacgtaccgacaatcactgcgggcagaacagaggcagttaacggcgttcaaaacgaccaaccaaactccggcgacatcgtagcgaaaccgggtggtgataacgacagaatggttgtgaagtataaggataatagcggtcaggataaagaaattgctgtgaagaaagatcttgagcaaggtaagtgggtgttggatgaaacacatccgactgatgcagataaaaaacctgctaaggacgactatatcatcaaagacgacggtactgtgattgtcaaaggttcaaaagtgaaggatggctcagaagcagaagcggtgggttataagactgtgggaagtgaatcagtagcatcaaacaaaccttatgaaactagtgatacaacagaaaacaacactagattgacaaccgttcaggaagccaagattaaggcgttggtagatgatactacaccgaaagaagctgatgcgcctcatttggtgaaaggtaaggacaatacctatcaacaaggtaccgcaatcattgaaccgcaaggggataatgagaaagttgttgtgtccttcacaggctacaccatgactccgacagcgatgccaggagagacaaacactaataatcagccaatcccaacagtgaaatctcagaatggtacaccagtcaatgaaaatgtagatatggtgctagtggctcaaaaagttaatggtttttgggaactctttgctgcaaccaaagcagattatgagaagttacaacaagcacaaacaacaccaaccgacaatggcgaaaaccctagcaatacaaagggtgttggacttgtttctgctaaagatgctggtattgcaactattgatccgaacacaggcaagattacccttaacgcaaatgcggttaaggatgactcccctgtgactgccaaaggctacaatgcgttaggattgccagcagaaggtaaagatgcggttgaaaaaacacaaggggcaaatggtcaaccagatcgactcacctctaatacatcaattaccgtaggcagcgatctccgtcaagatcaagacgttgttgcagataaaccttctcttgaacagctcagtaatggtgatatggtcgctcgtcctcatggtgataatactaagttggaagtgtcttttgagaagaaagacagcgctaacaacgagaaaacgacagttaccattgagcaggcagaaaaagatatttcctttaccgcagaagatggtcaagccacgcaaacggctaaggttaaagtctggaaattcagtgagaaccaacaaaatcttactgaagataatgatggtgatccaaataccatgcttatcaatggcgtgaaagttaaactgaacccagaaacgaccctatcccaaattctgtgtaaacacccatttcaacttaacggtgatcgtctaagcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccggataatcaaaaaatgtagcaatatttgcccagttatcttcccagcctttcaccacaagcgggtattttgcctgccatttttgcgaaagtgcggttagattttcacgagcttgtacttccgtcggggcctgataaacctgctttaaatctgcagtgacggctttgtaatctttccacgaaacgaatttcaagctgttacgcactaaatgcacaatgcaaagctgaaactacgatacaatctaggtaaacaattggataaaccgcatcaagtgggcgattttgccatgccattacgcgttctttcacggcgtcggtaacgcgagaaatcaggctggttgatacatccgcatcatagagttctttgaacatttcaacgatttcctgattacttaaccctttggaatataaggcaataatctgctcatccattcctgtgatgcgggtttggtttttcttgataagttgcggttcaaaggtgccatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttagatttttggcaaattccgctgccaaggcgtgaagttgtttttcgttcataataaaatacctgtgtctgaatgtattatctcagaaacaggtatttacacaaattgtgggagaggctcgttgagcgtgcagggtttcattggcggttgaaatcgttaaaatagcgacattttgccgctatttttgtatccatttccattgaataatcttatgttctttcactacgattctttctacgacacctttatttactaatcgagtcattgcattacctatattattggtgtggtattttgatataggggtattcggttgtttatctgcaattaaaaccgcttctgctaattctaacgcacgccaatatcgttcaggttcggctttcattactttttgaatcaattgcgttattttaccgttaaattgtttgcgataaactcgatattgaaaatgctcggtatcgaattgttgaatctctttgctatcaacttccattgcttctaaagctcgttctaaccacttaatacggcgttcaacaaggtcgagatgggctaatacttgctctttttctcgttcaaactgagcgattttctgtttaatttgcgtatagtaaattgggtctgccatattacattattaacctttctacttgtctgtgattaccttgccagtaccctttccaagcgttttctgatggtgtagaaaggcatttgctagtgatatcattgaaaatcgttaaattatccagtttgcgagtatcttcccgataggctatttcgttcgcataattatcgagataaatattactcattttatgaacttgtccgtagtacatacgtttaaagcgactaaagtaactttctgcaaggttattggtaatcccttcatcgctacgatattctttttgatggttcacacgctgtaagtcgtaatccacaattaattcatcataagcactgttttcatcggtatgaatacggctgtttggttcaatatatgcagtagccaatttcttcacggtttctgtattttctgacaaaatcggaaatgtgatggttctctttgctccgactaactgcggattagataaattatcctgttcagcgtaacgttcacgcattaccagtacgccacgtttatttggattggcattttcttttaaacgtctatccactcgttcacttttcttattctttgggcgtggagcagaatgcacgtaagtgccgtcaatatggatttcacctgacagcggaaaaagctcacgttgtacaatcaggctttcacggattttatgtgataaggtaaaagcggttttgtactgtacattcaaatcacgagaaagttggcaagctgaaatgccttttaccgcattcacaaataacgcaatagcgaataagtaggtttgaatcggcaacttgtggtttgcaaaaattgtccctgatgtaatgctaaatgtgtgtttgcaatgcttgcaacgccattgtttgcgagtagagataaaataagctttatgttgtacaccgcatttaggacaaactaccacttctttacttccccaacgtagctcgcacaataagctaaatgcttcatcatcagataggcgtgctatcttaatagatgaaagcgtgcgagctttgctggttaataggaagtgagatgccatagttgagtcgtttctttttgttatataaaagtcttgaaattacctaaaaatttgtttataggatatttaatctatgctcaaacgtgataaaatataccctatacaatgtcaaatatacgctcgtttgcgttatttgtcaatctaatattgaaaataggacgctcaaatgtgtatatcagaaagattaagacaagtttgtgaagctaagaattggaaaattaaagactttgcagagcaaacaggaattgcttaccgcaccctacaaggttatgttggtggtgaacgtgagccaaatgcggaaggtatgactggtatcgccaaagctggagtgaatttgaactggctcgtgagtggtgaaggggaaatgtttcagattgcaacacaagaaattgtaatgtcagaacaagaagaaaacttacttaataactatcgcacgatgccagaaaacttaaaagatgctttctcgatttcttttaaagaaatttcagagaaacagtaattattacttgacatactaaaataaggatctcaaaaatgttcaacgcaacgcaacgcaacgcaacgcaacgcaacgcaacgcaacgcaacgcaacgcaacgcaacgcaacgcaacgcaacgcaacgcaacgcaacgcaactgtgaacgagttttaacttttgtcaatacttttttctctattttatctaaaaaattcgaggaggctgtatgccacagctaacttggattggaaaagataaagtcaaaaaccatcatcacgatgttccttttcatcttcttgaaaaacaatacgattttaaagcgaatagcgataaacctgaaaatagcaaaaataatatgctgattcagggcgataatctcttggcgttaaaaagccttttgccaaaatatgaaggcaaaattaactgtatttatatcgatccgccttataacacagggaatgaaaaatgggtctataacgataatgtaaacgatccacgtatcaaaaaatggcttggcgaagtggtaggcaaagagggtgaagatttatctcgccatgataaatggctttgtatgatgtatccacgtttaaaattattacatcgtctattggctgatgatggagttattattatccatattgatgaaaatgaatacaccaacttacactctatattgattgaaatttttggtaaaacaaatgatcttggaacaattatttgggataaacgtaacccaaaaggtgatagtcaaaaaatatcttatcaacacgaaagcatagtattgtttggtaaaaatcaatttcatacaacacataaacttaaacgcttaaagaaaaatgccccagcaatgttaaaaaaagcgaaaatgttatttaagaaaattggaaagaaacaatacccagaaaatcttaaaaaagtcgtcaaagaatataatttatccactgaaattttagaacaaaataaattaattgcagatttagaatgggttaatcaggaatatcaggattggcttaaaaaacaggatttttctaatggcgagaaagcctataaattcattgatgaaaatggagatatttttcaaactgtttctatggcgtggcccaataaagaaaaagcccctgatgagtattttattccattaattcaccctgtaactaaaaaagagtgtcctattcctgaaaaaggttggcgttatccattagttacaatggagaaaatgttaaaaaataatgaaattatttttggagcagatgaagttacgcaacctagaagtaaatatcttttaaaagaaaatttatatgaaaataccccatctattttagcctttggcggtagcgatgataaatttcagaaagaaattggtattcatttcgaaaatccgaaaccgaatgaattttctaccgaattgctttcctcatttttaaaacctaattctatcgtgttagatagctttatgggcagcggcacaaccgcccacgcagttttaaatcttaacgccaaggatggcggcaatcgccaatttatcggtattgaaatgatggattatgcagaaaatatcactgcggaacgaatccgtagggtaattaatggttacggttcaaaagcagaaacgcaaaaaggcactggtggaggatttagtttttataccattggagaaaccttgtttgattcagacggcaatttaaataatcaggcagatttaatcagtattcgtgaatatattgctcatagcgaaaaactagaaaccgtttttgataaccacacaagcggttattttttaggtttaaattaccaaacagcatatattttttattacgaatcagatcagataacaaccttaagcctagattttttacgcagtttaaatgccgattttatggcagaaaaaccacaagattttgttatctatgcggataaatgcacattaacggatgagcaattagctcaatttaaaatccgttttaaacgaatcccgcgagacattagtaagctataagggtgttgcaatggaattaaacagttatcaaacacaagtgattaatgatttaaacgactatttgagtgaattaaatcaatatggtagccataaattgaaacaagccttttcaaattattgggtgaaaaaaggtgtacctaatcaacagtatgtagagaaaattaccaatacgccccacgtttgcgttaaagtgccaactgctggcggaaagacctttattgcggttaatgctttacaatcaatttatagtgcggtcgaatttcacggagaaattcaaccacgatttaccgtttggcttgtgccatcaacggctattttagagcagactattcggaatttacgcaatcctgatcacccttaccgtcaaaaattaaatgtgctatttaatgggcgtgtgaatgtgtatgaaaaagatgatgttttattagggcgtggatttgatgcagataccgtgaaaagcggtatttccattgtggtaatgacttttgatgcgtttagaacgagaaacaaagaaggtcgtttaatttatcgtgaaaatggctatttggcttcttttgataccaaagctaccgcattgcctgatagtgatgatacttcgctaatcaatgtaattcgcagccttgaacctgttgtgattgtagacgaaagtcataatgccacatcagatttatcgctagaaatgctaaccaatctaaatgcaaaattcatcttagatttaaccgctacaccaagaaaagaaagcaatatcatttcttatgtcagttcactagcattaaaaaaagaaaatatggtaaaactacctgttaatgcatctaatcaagcaagtaaagaagatgtactgatttcagcggtaacgtttcaacatcatttagagcaagttgctcaaaaagcctttggaaatggcgaaccttatgttcgcccgattgtattatttcaagctgaagcgaaaacgaaaggagataatacgacttttgaaaaggttaagaaaatcttaatcgaagaattaaacattccaaccgagcagatcaaaatcaaaactgctgatatagatgaactaaaaaatgttgatttattttcgcctgattgcccagttcgttttgtgatcacggtaaacgccttaaaagaaggttgggactgttcttttgcttatattctagcgaaccttgcaaataaacattctgaaattgatgttactcaaattgtagggcgtattttacgccaacccaatgcgaaaccgtttagcaacccattgcttaatatgagttatgttttcacagcatcagcccaatttagaaatgtgctaggtaatattgtggaaggtttaacattggctggatttagtccgaaagattatcgagtaatcagcaataatagtgaatgtaatcaagaatttgcttcagagtttgataatctgccattaacattgccctcccaacaaaatgagctaactgagaatgaatcttttgactttgatacagataaattaaaagaaaatattcagcaatcaacaatagaaaatgctgaaattaatcctatctcagataaatttatccaagatgttgtaaaacaaggcgagagttttaatttagaagtgcaaaatagtacagttattgttccgaatgaattaaaagagaaaatgaatatggtaaagctcaataataaatttatagcatcagttgaaaatatccgtattccgcaattctttgaaacaatgaataacggactatttgaagatgttgttttgtttgaaaaagaaaacttattaacgaaatttgaattgaaacgatgtgatacacaaatttctttttcagatttagatcctgaattatatagtgttgatattgaaaatgaacaaaatgctaaatttacaccattaagcaaagaaaagtcagagcagttattacaactgtttagcaattattcattagaaagcaagaaaaaaagcattgtagaatctttgtttaatttctctggcaaaaatgctttttatcctattgctgattccgaaattaaaatttatttcagaagaattgttgaacaaatgagccttgctgatatggaaaattgtttgattaaaccagcaatctattttgataagatcaaacagaaaattaaacagctccaagaagactttgctcaagaagaattttttaaatggattgatcaagaacactttcagattaaagcagaatatcaacttccaaaagaaatttatccaaaaagttttgcagattcattaagtcataacctgtatgaaaaagaagcagaaatgaatgactctgagttcaaagctatttctctcttgattagcttggaaaatattatttggtggcatcgaattgatgaaaagcgaaaggattacagtttcaggataaacggttttatcaatcattaccctgacttcttaattttaaccaagaagaatgcactaattttacttgaaataaagggtgaacatcttgctaatcctgaatctaaaagaaaattagaattaggtaaaaaatgggaatctctagcaaatcaaattggtttacctcataaatttagatattttatgacttttttaagagaacctatggaaggagctaaatcattagatgaattgattgaaacgatttccaaactgtaattatttagcgaattccagcttgctttattttgggtttgcaactcatttattaaagtccacgtatttcttgtggcagtatggcattcaaggcaaaacgctttgagccgacctgaaaattcaggtgggcgattttttatgtctggcgtttagctttgagtgccttgtacacacaaggaatacttatggctcattacttactttcaagcaaatctaaaacattatcccttaaacacatcttccgtctaagtgaagatgaagccttccaacttttaaaagcaaaccgttggggcaatcctgataatattcacgatgtttgttgtccgcattgcggtatacgccacaatgcttattttcttcaatctcgtaaacgttggtgttgcaaacattgccaacgtcacttctatattacaactaatacggcatttgcttttcataaattaccatttgttgatattttggcagccattcttctctttgcgaatgaagtcaaagggatttcagcaataacaatgagccgtcaccttaatattagttataaaacggcttttgtcctttgccataaactgcgtgaagccttattcaaaactcgtgatttaacgccattacaaggggaaattcacgaagatggtgcgtggattaatttcaaattacgtccaattaacttcgctaaaaacgcctataaacagaaacaaaaagccgataaaaaaggacggaagtttctaaaattcagaccgactaaacgctgtatcatcagcttaaatcaacgtgcttctaatgatgaaacattatggggttcaagtcgtactattgtggcaatggactatactgaaaatgccaaaacaattttggcattaaaccatcaattcgtgaaacaaggcagtgatattatgtgtgatgaaaatccagcctataaaggtttagattttcattacactcgttggagtgttaatcacgatttatgttacagtgcaaaaggcatcaataacaatctcgccgaatcctttaacgctcgtttccgtgatttacatcgtggtgtacatcacaaatgcgataacaaatacgccctacattatgccaaccaagcggcgtttatgtcagataatcgccaaaagtctaatggtgagctgtttagtgatattctaaaacgttgtttatgggtattaccattaagggaatgggtaggttactggcaagggaatcatcgcacgctagagcttatcggtatgaccgcatttagccccgaagaaatttcccagtcctacttcaaaaatctcaatgaaagaatgaagtacgagcaagagttactggctgcctaatttgcttaactaaaaaacgaattgaaatgtaagtacagagaaatcagcttacctttgacaaggttgagcggattggctacgcccattggtgggaaaatttacatcgcaagccaataatattggcaaacaagtgggaaaatcagctaaaatttacaaaaagaaatgcccttaacaattaagggcatcaaaatttttactgcggttgagattgcattttaggttttgtgcaactgctacataataccggtactataagattttaagccatttttagtggccattttgtatactatgctattttaggagtaatagacttttcttataaaaacgacttcattggggtatagtagacaaatttgttgctaaaacatttgcacaatacgatccagttcaaccttagctgcttcaactgctttagctgcaacttcaggaccataaccgataccttctgcatacacaaactcaacatcagtaataccaataaagtttaacaccgtttgcatatacattttagctaagtccgcaggaccatctttataaataccgccgtgagcaagcactaccactgcttttttacctttgattaaaccttcaggaccattcgctgtatagcggaaagtcacacctgcacggtttaagtaatcaatataagttttaagttgtgcagggatacctaagttgtacattggtacggcaaatacaagcacatcactgttattcacttcaccaatcaatttgttagataaatcaagtgctgcacgttgagcatcattttgcggttcatcacgtgtacctgatgccgcatttaaatcataataaggaagtggatttaccccaaaatcgtgttcagtcacgttcgctgtgattttagatttaaggtaatcaactaatttgtttgaagtggaattatcggcaagaatacttgatttgatcactaatacatttttcattaaaaactccggatatcgaaaatacgattgaataactgtgttagtttatctgaatataaaaagaaataaagtagagaaaagtgaaaagagtgtttattaaaatgaaataatatatcaatttgcaaaatattaaattgttctgaccgcttataaaacacaagctcaagtatttacttgagcttgtatataaaaagcgtttactactcttttttcatttcagacgcaaacagataagcacctacaaagattctggttaaagtatctaataagtaagcctcactaataccctcctcaacatccagatcatctttcaaagcaagatcaccatctttatcaatataagcagttaaaaatctttttgttgcattccatttattgacacttttcaatgaagtattatcgccatcaaaatacatcctaaaagttaaagagccatcgtcacgttgattataaattaccagctttatcccagagtcgctggtaattctaatccttcctttttcaatcagctcaacttttggatattttttcttcacaatatcaatcaattgttgatcagaaaacttagtataaacttccaccattttggtttctgcataagctgttgtagaaacgagcgtagtggtaatcaacatggcaaaaaacattgatagaaaataagctggcgttttgaggtatttataaattttcataaacacccccaccattttctaactgacgatagagattgagagaaagtttatcccttgtttgagcggcaatatctgtttcgtaaagttgcttatcaacaggattgcttaaatcatattggtagtaggttccacttaatcctttataagcaaacataccgtttttcatctgttctttaatcataaatataccttcatagtaatgctaaatgttttggcagagatgattttagttcattacgcaagtaatgaattaaataatgctagcattattgaaaattttgattaaaaaatggtaataagcggtaagatataagaagaattttgaaaaaacaaaagcccgataaatctatcgggctttttaagtcaatgtagaattattctgctgcttgttcagctgcaacttcaggacgatcaactaactcaatgtaagccattggtgcgttgtcacctgcacggaaaccacattttaagatacgagtataaccacccgcacggtttgcaaaacgtggacctaattcattgaataatttagcaacggtttcgatgttgcgagtacgagcaaaagctaaacgacgattagcaacgctatctacttttgctaaagtaattaatggttcaactacacgacgtaattcttttgcttttggcaatgttgtcttgatgatttcgtgactaactaatgcacttgctaaattacggaacaacgcctgacgatggctgctgttacggtttagttgacgtccactcttacgatggcgcataaccttattccttctaagaaaatctaaacctaaaattagtcttcagcaatacttgctggaggccaattctcaaggcgcataccgagtgataagccacgagaagcgagaacatctttaatttcagtaagtgatttcttaccaagattaggtgtttttaataactcaacttctgtacgttgtactaaatcaccgatatagtgaattgtctctgctttcaaacagttagcagaacgaactgtcagctctaagtcatctactggacgaagaagaattggatcaaattccggtttctcttctttcacttctggctgacgaacatcacgcaaatcaacgaatgcagcgagttgctctgctaaaatcgttgcagcacggcggatggcttcttctggatctaatgttccgttagtttccatctcgataacgagcttatctaagtctgtgcgttgttcaacacgagcagcttcaacattgtaagcaatgcgatctaccgggctaaaacgtgcatcgactaataagcgaccgattggacgatcgtcgtcttgtgtatgtacacgagcagatgctggtacataaccacgaccacgttgtacacggatacgcatactaattgatgcgtttttatccgttaagttacaaataacgtgatctggattcacaatttcaacatcaccatcgtgagtaatgtctgctgcagttacagggccaatcccagatttagtgagtgtcaaaataatatcatctttattttgcacttttaccgctagacctttaaggtttaacaatacctcaagaatatcttcttgtacgccttctttgctgctgtattcgtgtaatacaccatcaatttctacttctgtaactgcacaaccaggcatagatgaaagtaaaatgcgacgaagtgcgttacctaaagtgtggccgaaaccacgttctaacggctctaaggtcacttttgcgtgagttgaactaatttgttcaatattcactaagtgtggctttaaaaattctgttacagaaccctgcattttatcctctctttgcttttaagcttaactattatttagagtaaagctcaacgatcagatgttcattaatatctgctgatagatcagaacgctcaggagtacgtttaaatacgccttccattttagttgcatcaacttctaaccaagttggtttttcacgttgagtagctaactctaatgatgctttgatacgtgcttgttttttagatttttcacgaacagcaatcacatcatcaacagaaacttggtatgaaggaatgtttacaacacgaccatttaccacgatagatttgtggcttactaactgacgtgcttcagcacgagtagctgcaaaacccatacggtaaacaacgttgtctaaacgaccttctaacaatactaataagttctcaccggtattgccttttaagcggttagcttctttatagtagttacggaactgacgttctaaaataccatagatacggcgaactttttgtttctcgcgtaactgactaccatagtcagataaacgaggcttacgagcaccgtgttgacctggtgctgtatcaattttacattttgactcgatcgcgcgaacacctgatttaaggaataaatcggtaccttcacgacggcttagcttgagttttggacccaaatatcttgccattttctttctccaattatcctaacgtcaattacacacgacgttttttcggtggacgacaaccgttatgtggaatcggagtcacatctgtaatgttcgtgatacggaaacccgctgcgtttaatgcacggattgttgattcacgacctggacccggacctttaaccataacttctaaattctttaaaccaaactctttaaccatttctgcacaacgctctgcagcaacttgagcagcgaatggagttgatttacgagaaccacggaaacctgaaccacccgcagttgcccaagctagagcattaccttgacggtcagtaatggttacgattgtattattgaaagatgcgtggatatgagctacgccatctacgatctgtttttttacacgtttacgtgcacgaactggtgttttagccattatttatctactccgattattttttgatcggtttgcgtggacccttacgagtacgcgcattagtcttagtacgttgaccacgtactggtaaactacgacgatgacgtaaaccacggtagcaacctaggtctaaaagacgtttgatgcttaaagttacttcacgacgtaaatcaccttcgacagtaaatttaccaacttcttcacgcagtttttcaatctgctcttcagacaattctctgatcttcacatcttcagcaatacccgttgcagcgcagatcgcttttgcacgagttttaccgatgccataaatagcagtcagtgcgattacggtgtgtttttgatcaggaatgttaatgcctgcaatacgggccactatgcactcctatttaactaaagttattgatatgctgatcttgaaaagcccgtttcaggatactcaaacagcatatcaggacgaaatgagctgagcagtataaccgctcagcaggttctttgcaagaaataatgtcaattaaccttgacgttgtttatgtttagggtcgctacaaattacgcgtacaacaccttcacgtttaacaactttgcagttacgacacattcttttaactgaagcacgaactttcattgcttatccttttgatctaagggcttattgccctaagcctttcaaattggctttcttcaacacagaatcatactgtaaagacattagatgactttgaacctgtgcgatgaaatccataataacaaccacaacgatcaataatgaagtaccgcctaattggaaagatactttccataatgatgttatgatataaggaaccaaacaaacaaaggtaatatataacgcaccaattaaggttaaacgtgtcattactttatcgatataacgagatgtttgctcgcctggtcgataacctggtacaaatgcacctgattttttcaaattatccgctgtatcacgaggattatattgcattcctgtataaaagaatgcaaagaagattacagccattgtaaataatacaatatagagtggctgacctggttgtaataactgtgataaatcaaataaccattcaaaaccttcgcttgttccgaaccattgtgcaatggttgctgggaataaaataatacttgaagcgaagattgctgggattacaccagccatatttactttcaacggcaaatgagattgtcttgcaggtgccatcattcttccctgctggcgacttgcatagtttacaacaattcttctttgtccacgttccacgaagacaacaaaatatgttacagcaaatgcaactacagctattagtaataacactaataatgaaatctcgccttggcgagattgttcaatagtttgcccgattactgatggaagatcagcaacaatccctgcaaaaataattaacgaaataccattaccaatgccacgctcagtgatttgctcacctaaccacatcaggaacatagtacctgttactaaactaattacagaagttacatagaacagcatatttggattaggaactaatccagctagcatattcggcagggctaatgaaataccaatagactgaataaatgctaataacaacgtagcataacgtgtatatttgctaattttacgacgccctgcttcgccttcttttttcaactcggcaagtgctgggtgtaccgctgtcaataattgaataatgattgacgctgaaatatagggcataatccctaacgcaaatatagaagctctacttaaagcaccaccagagaacatattgaacatatcaatgatggtgccttgctgttgtcgtactagctcggataatacagaagcatcaataccaggaacaggaataaaagaaccgatacggaaaacgattaaagcacctaaaacaaacaataatcgtgattttaattcaccagtccctttttgggtattaccttgatatcctggttgtttagccatttattattcctcgatagaaccaccagcagcttcgatagcagcttttgcacctttagtcacgcctaagcctttaatcactactgctttttcaactttacctgaaagaattacttttgcagataaaatatcttttgtgattacgtttgctgcttttaacgcatctaaagtaacaacattaccatctacttttgctaagtcacttaaacggatttcagctacgtgtaatgctttaagagaagtaaaaccaaattttggtaaacgacggtataaaggcatttgaccaccctcgaaaccacgacgaacaccgccgcctgtacgagatttttgacctttatgaccacgaccaccagttttacctaaaccagaaccaataccgcgacctaaacgttttgcactgtgtttagcaccttcagctggagaaagagaatttaaacgcattctattattcctccactttaaccatatatgaaacttgattgatcataccacgtactgctggagtatcttctaactctacggtatgacgaatatgacgaagacctaagcctttcaacgttgctttatgcttcggtaaacgagcgatagagctacgagtttgagttactttaatagttttagccatattcaattaccccaaaatttcttcaacggttttgccacgttttgcagcaaccatttctggtgatttcatatttgctagtgcatcaattgttgcacgaacaacgtttattgggttagttgaaccgtacgctttagaaagtacgttgtgaacacctgcaacttctaatactgcacgcattgcaccacctgcgatgatacctgtaccttcgctagctggttgcataaacacgcgtgaaccagtgtgagaacctttaacagggtgttgtaatgtaccttcgtttaacgctacattaaccatattgcgacgagctttttccatcgctttttggattgctgccggaacttcacgagctttaccgtaaccaaaacctacacgaccgttaccatctcccaccactgttaaagcagtgaaactcataatacgaccaccttttacggttttagatacacggttaaccgcgattagcttttcctgcagttcaccagcttgtttttcgatgtttgacatctcaaattcctctattagaactgaagaccagcttcacgagcagcatctgctaatgattgcacacgaccgtggtatttgaaacctgaacggtcaaatgcaactgctttaatacctttttctaaagcacgttcagcaacgattttaccaacgactgctgccgcttctttattaccagtatatttaacttgctctttaattactttctcaacagttgaagctgctgctaaaacttctgagccattcggtgcaatcacctgcgcatagatatggcgaggtgtgcgatgcacaactaaacgtgttgcaccttgctctctcattaaatgacgtgcacggcttgcacgacggatacgagctactttcttatccatagtgttaccttactttactttttcttcgcttctttaatacgtacaacttcatcagcgtaacgtacacctttacctttataaggctctggtttgcggtatgcacgaatatcagctgccacttgaccgattaactgtttgtccgcagacttaagaataatctcagtttgtgatggacattcaccagttacacctgctggcaactcatgttcaaccgagtgtgagaaacctaaatttaatgcaacagtgttgcctttcatttgagctctgtaaccaacaccaactaattgcaatttcttagtaaagccttcagtaacaccgataaccattgcattaacgagggcacgagctgtacctgcttgcgcatctgcattaacgatacccgcttttggagcgaatgttaaagtatcagcttcgtattttacttcaactgcattgtgaatttcgcgagacaactcgccatttttaccttttactgttaatagctgaccattcaaagtaacttgaacgccggcaggaacagcgacaggtgcttttgcaacacgagacatttttcctacctcactattatgctacgtaacagataatttcaccgccgaggctcgcttgacgtgctgcacggtcggtcattacacctttagatgtagaaaccactgcgatacctaaaccacccattacttttggtaactcgtctttacgtttataaatacgaagacctggacggcttacgcgttggatactttctacaactggtttgttttggaaatattttaaagtgatttccaattcaggttttgaaccttcaacaactttgaagctctcaacataaccttcttcagctaaaacgcttgcaatagcaacttttaacttagatgaaggcatactgattgcaactttattcgcagcttgaccgttacgaatacgggtcagcatatctgcgattggatcttgcatgctcatgtatttactcccatgattccaaattaaaagaggttattaccagcttgctttcttaaggcctggaatttcaccgcgcattgcagcttcacgcaccttaatacggcttaaaccaaacttacgaagtacaccgtgtggacgaccagtttggcggcaacggttacgctgacggattggactagaatcgcgtggaagtgtttgtaattttaacactgctgcccaacgatcttcgtctgaagaatttacatcagaaataattttctttaactcttcacgtttagcgtagaatttatcagctaatttcgcacgttttacgtcacgtgcaatcattgattgttttgccacgataacctaccttatttacggaatgggaaattgaaagccgctaataaagcttgaccttcttcatcagttttcgctgtagtggtaatagtaatatctaaaccacgaacacgatctactttatcgtagtcgatttcagggaaaatgatttgttcacgaacacccatactgtaattaccacgaccgtcgaatgatttcgcgtttaaaccgcggaagtcacggatacgtggaacagcgatagtaatcaatctttcaaagaattcccacatacgttcaccacgtagggttactttgcatccgattggatatccctgacggattttaaagcctgcaacagatttgcgtgcttttgtaattaaaggtttttgaccgctgattgctgttaaatctgctactgcattgtctaacagttttttgtcggtcaatgcttcacccacacccatattcagggttatcttttcgattcgtgggacttgcatgacagatgagtagttgaattttgcttttaattcattaactactgtatctctgtagtaatcatgcagtttcgccatcgcattactccagttaattaaattgttttctcgttagatttgaagaaacggacttttttgccatcttcgaatctaaatcctacacggtcagctttatttgtttctgggttgaaaatcgcaacgtttgacgcatcaatcgcagcttctttcttcactaaaccgccagctttgcctaaagcaggaactggtttttcgtgtttagtgataatgttgataccctcaacaaccactttaccgtttggtaacactttagttaccttaccacgtttgcccttgtctttaccagcaagaacaattacttcatcgttttgacggatttttgcagccattacattctctccttatagtacttctggagctaaagaaatgatcttcataaacttctcagaacgaagttcacgcgtcacaggtccaaaaatacgagtaccgattggttgctcagtgttattgtttaaaattacacaagcattgccatcgaaacgaataactgcgccatctgggcgacgaacacccttcttggtgcgcacaacaactgcttttaacacatcaccttttttaactttaccgcgtggaattgcttctttcacagtaactttgatgatatcgccgatagcagcgtaacgacggtgcgatccacctagaaccttgatacacattacgctacgagcccctgagttatcagcaacatccagcatagtctgttcttggatcatattagtgctccgttaaaataaaaaacaccctttcgggacgaacctatttaccctatgcaaataggttgcggattatatcgcaattagcgtaataagatcaactgaattttattagaatgcattagagagtacagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatttcgggggcaaacagctggactgaaatcaaactttttggcgaattacatttggattggttgcgaaaatatcgtccttttgagtgtggcattcctgtcgatgatactatcgcccgtgtaataaaacgcattgagccacaagcatttaatgaggtttttcttaattttatcaatgagatacgcacacaacaaggacgtgaagtgattgcgattgatggcaagacacttcgtcatagtttcaatccggaaacccaaagtgctttgcacagtgtgacggtgtggagccagtctcgtggtttgattttatcgcagaaaaaatcctcgggtaagcaaaatgagcagcaggcggtgatggaaattatcgatagtttttgcttaaaaaatgccgttataacggtggatgcgatgaatacacagaagaaaattgccgagaaaatcatcgaaaagaaaggggattatgtgatgccgttgaagaaaaatcaccgtcaatttcagtcggaagtggaggcgtattttcacaaaatcagccgagattgcctcgaaatgcttgagacgtttgaggaggtaaatgcggaacgtcgtcgaattgatgagcgttactaccgtaatctgaaagtgagtgattggctgagcaaagcggaggaatggaaggggataaaatcggtgttggaggtgtgtcgcaagcggtcagataatgacaaagaatcacaagaaaaagtcttttatatcagtagtttggatgttgatattcaaatattggcgaagtgcgtgcgagggcattgggaagtggaaaacaaagcccattgggtgctagatgtggtctataaagaagacgaatgtgctgtgaccgatgaatggggtgcggaaaatctggcaatcttgcgtcgattagcgttgaacttggcacgattacacccgaaaaagcagagtatgaaagggaaattgaccgctgctggttggtcagatgaatttcgagatgagctgttgctcggcgtgtaggttgaaaaatggacaacatatgcggttgccctgttagagagtaggagttctcctcattcactactttaaaaaagtattaggattaataatcattggcgcaactattttacatgaataaaaacaaccaaattttgtgacccatctctcaataacatcgcggaagactaggcatttttgatattctatgattaaaatgcacttatttattttatcgaagcaggctttatgaaagtatcttccattgctattttagtcagtttattgagtttaaattgttgggcgaatgatgaaattgttcgttcccaacaagaaaaccaacaccaattacaacaaatccaacaacatcaacaatctcgttgggtttcccaacatcaattccaaagccagactaaagcacaggataacagtacggcaaccgaacattattgcttacgttacaataggttacagataacgggtgtaactttaatcgatcccctttcatttcagccattgccctacgaatgtttaaatgaaaaccgccttaatcaacttagccgagatttaacgcaagcctatttggataagggctatattcacaatccatttcaatttgaagatgatggttcgaaaacgctgattttacgagtaaccgaaggcaaagtggctaaattgacggggggaagttcgcaagtaaacttagccatgctgtttcctaacattgtaggtcaaccattaaatatcaaagaattagatcaggggctagatcaagcgaatcgtttgagtagcaatcaagtttctgtcgatgtattacctgccaaaatggcgagatcgaactctcttttgtcaataatccctcgcctgctgtttccggttatattggtgtagataattttgcttcacgccaatatcatcgttggcaaagccgtttcgggttaaatgtagatagcccatttggactgtcagatagcctttatttgggcggaagccacacgttaaaatcgacaccggaatttaatcgctctgcaattttatattattccgtaccttatgggcgttggacctttaacagctttggttctgtttcgcaatttcgccgacaaattccgttggtttatcataatgtcgagcaaaaaggtcgaacgtggcaggctggggtggaagttgattatgttgctcatcgaggggcaaaccatatttccacaatttctgcacaagtagaacatctgaatagtaaaagtcgttttgaggacagtgtgatcgagttacaaagccctaaattgagcgttgcacaattctcttttaaccacttacagctactgtcgcaaggttcgttgatctttaaccttgattatcgtcggggattggcttggtggaatgcgattaaaaatcaaggacgagatcagcctgaagggcaattccaaaaatggagtggcgatgtacagttgagttactttcatttgttaggttcgcaaaaattccgccaatctcaccgcttgtttggtcagtatagttcaaattatttgccagccacagaacaagcggatttattaggacgatatgcagtaagaggcttccaagatttatcgctctcggcagaaaaaagccttgttatgcaaaatacgttaagttggttaaataactatcgatctttacaaatagagccttacgccttgtttgatctgggggtacagaaaaatagcagtgataacgctcatagccaacgtgctttcggctatggtgctggacttcagttagctaaaactacgtggaagtcggatattcaatgggttaaaggcaaaatgcaacgagaaaaaacacagatgtgggaaaaagaacaaagacggcaaattaaccgttcaggtggaagaggcaaaaggaaaagtactcgatggtcgtgttgtaggcagtatgcaagcggagagaatccgtatccattctaccgacaatcgtgccacacttaatgttgaagcggcggatatcaaggcaaaagatgttttagttcaagctggcaatgcaaatgttcaggggaaagtgaccgctagcacccactgtcaacataaccactacactgcagacaaaaacgttaaagtagaagagtaccgttccagcaaaaatgaaaaatatcaagcaaccaaaatccaagcggataatcttgttgtcgatgtggataaccgtttaaatgtttctggggcagatattcaagcgaaacaagcgagtatcatcggtggtcaaacccattttggtacacaaatcacaacgaacgaaagtaacgcacgtaaacatcaatctaaaggtctttggttccgtgaagaaaccgataaaactaaagctcaaactgttcaccgtaccactgtgactgcagataaactcaatgtggtagcaacaaaaggtcaagtaacggggaatgcggttaaattagcagggcaagatgcttttgtttatggtgataaaggcgttgcattaaaaggtgttacacaaacaacacaagctgaagcgacaagcaaatttaaaaaatgaaactgcccgcttgcgtacaggttctagttcacaaacagccaatacccaagcgttagtggcaagtgaattacaatttaaaaaccttagcgtaggtggcagcgatgtacatttgagtgcggtgaaaggtcaaattgacggtcaactctttgtgcaaaataaaggtaaagctgaatttgtcagccaagcgaccaaaaacacttacaactgatttcaacaaaaggcattaacgtgattggtagtaaagtgcaagcggtgaatactttaggggtttatgcaccaaccgttgaagtgattggggcgaaaaaccaaagtttatcaatgaaagaagaagctggatttggtatttccgcaaaaggcgataagccaaaagtgacctttaataccgaagcggcactacgtggtgttatcacatcactgatcaaaggcgaatcagtaaacgcacttaatgttgttaaaggcaatactcaatttgaagcacaaggcagcattaccttaggcatttataaccacaaacaacagaatagccaaacacaaactgcacaagcgagccaattaagtgcgaaacaaaacctcactttagaggcagagcgtattcaacatcaaggttcacaactttctgcaggcaataacattgcacaaggtgcagaacatatcgaacattctgtggcaacgaactcacaaaatgatcgcaccaaaaatgtggacgtaggattgtcggtcacttcatcgatcaacaaagataaagcgatcagcagttctgtcaccttatctgcttcaggtggtcgtgaaaacagccaaagcaccacagcacaagcaacgactctcaatgccggcaatagcattgtgatcaacggtcaaaccttgcaagatactgcaacacaatatcaagctggtggcgatttaacccttaactctcaacaacataacttacaagcagccgtaaatagcagcagtaaagatacaatgaaggcaggggtaaatatcggcgttagtggcaacacgagcgacctcaaaaccgttaatctgaaagtgaatgtaggtgcaaattaccaacaaaatcagaccgcttctgagcaagctcaaaaagcctctttaactgcgaataacattgcggtaaatacaaacacgctttacagccaagcggatatgaaagcagatggcaacattaacgtggtggcgaaagagagtgcaacctttgctcaagcaacgaataaagagcaacaaaatggcgtaggctttaaagcagatcttggcgtaggggcattagtcgttcctgccgcaagtgctgctattccaagcgttgatgcaagtgtttcagtaaatgccgtaaatggtcgcacacaagatgcggttaccgctaaagttgaagggcaatcaatcaccattcaaagcggtaaaaatacgctagtacaaggcacaagtttggcggcggacaacatcaacttaagcggtgagaccgtcaatgttgtggcagcgaaaagcgataaacaactcactgatgttgcagtgggtacggcaatatccttaggtaaaggtgcatcaagtttaggcttaaatgcgaacttgaaagtacatcatgaagtttctaatagccatactgcaagtcaagttaccgctcaaaatctgaatattcaaagcagaaatgacattacccttactggcgtacaagcagatgcgaaaaatgtgaccctaaacagtggcaatggcaaccttgctttaaccgctttacaggataatgtgaagaaaacaggcgtaggtgcaacactctcattaaatggtggtgtagcagaacaaaaatggacaccaaatggcggcagtgcttcccttgatgtgaatgttattcgcaatcaaacccacacaagtaccgtagttaatagtgaaactgcgaacctcaatgtaggtggtaatgcactcttaacaggtagtgcattaaatgcggacactgtttctggtactgtgacaggcgacttaatcagcaaaggacttgtgaataaagtcagcgaaacaagtgtgagcgtttctgcaagttaaaccaatccaacataaccatcattaaataagtaagataaattagggaaaaaattgaattaaacggaataatgtgaaataaaaaatgaaaaggcattacacatagagaaataaaaaactcagccgagagcctctcccacaatttgtgtaaatacctgtttctgagataatacattcagacacaggtattttattatgaacgaaaaacaacttcacgccttggcagcggaatttgccaaaaatctaaaaacaccggaagacctcaatcaattttcacggatgctcaagaaaattaccgtcgaggctgcgttaaatgatgaactgaccgaccatcttggttatctaaaacgaaaattcagctttgcattgtgcatttagtgcgtaacagcttgaaattcgtttcgtggaaagattacaaagccgtcaccgcagatttaaagcaggtttatcaggccccgacggaagcacaggctcgcgaaaatctgaccgcactttcgcaaaaatggcaggcaaaatacccgcttgtggcgaaaggctgggaagataactgggcaaatattgccacattttttgattatctggctgatattcgtaaagcgatttataccacgaatgctgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactgacgatgaatcgatttatgattgattttggtgatcgcctagacgatcaccgttaagttgaaatgggtgtttacacagaatttgggatagggtcgcttgtaaccagcaaggttgaaacaggaatacaacagaaatcgctatatttatagctttttacagctatttataggattttataggtttgtaagagcggctggttaagttcactttaagatctttggttaataaactttcccctgcacttctcacataaagatttaaaaagcgagttgccattaaatcgttacttcccattggaacagaaagcccatacactccatctttcgtcaatgcttttgcggtatggtaaagttcgtcccacgttttcggtacgcttaaattatttgcggctaacaaatctttgcgtacccacatcacttgagcgtgagaatagagcggaatagaataattttgccctttaactgtaccttcataaattgcaccttcagcaaacttatcacgaccgatactatcaattagatcgcctatcggttgcaatgcaccgaaattaatcatttcaatgacgtgatttagtaaagccgtactcatatctggcacattgcctgaagataagcctgttgtccatttggtgtaaaagtggcagatgcagcaaggcagtcaatgatacaaaaggcacagattacgattacttaagaatacagacaaacgatatttcagcttacatttgttcgcatttctctggctttttctcaatgaaaaaagtatattggcgaacatttgtaagctgaataaacaggataaaaagatggcttctctcgacttccattttgtgaatagatttcgcctgcaagcaaaaaaatggcttaatcgtaccgctttgcgtttccgtgaacaagctcaatggcaggaaatgtcgtggcaaacttttcaacaggaaattgaccgtttctcttatgctttaattgctcaacatattgatatccaagataaaatcggtatttttgcaaataatatgcctcgttggactattgctgattttggggcaatgcaggcaagggcggttgctgtgccgatttatgcgacaaacacggctaaacaagtggaatatattgtgaatgacgctgacattaaaattctctttgtcggtgatcaagaacaacttgatcaggtctgtcaaatagcgaacaactgtccacaattaatgaaaattgtggcaatgaaggcgaatatggatttgagggatctgccaaatgcgtgttattgggaagattttctagatgttgttccaaatgaagcggaatttgagaaacgccttaattctaaacagttgtccgatctttttacgctgatttatacgtctggaacaacgggtgagccaaaaggtgtgatgctggattatgctaaccttgcccatcaattaaatgctcacgatcttgccttaaatgtgaatgaagatgatgtgtcgctttcgttcctaccgctttcgcatatttttgagcgtgcgtgggttgcttatgtttttcatcgtggtgcgacaaattgctacttggaagacaccaaccacgtccgtgatgccttgactacactgaaaccaacggtgatgtgtgcggtgcctcgtttctatgaaaaaatttatacggcggtatgggataaagtggaaaaagccccggcacatcgccgagccttgttcaactgggcaattcgtgttggtgaaaagcattatcaaacagaacaaccctcacagtggcttcgtttgcaatatgctttggcagacaaattagtgctgactaaactgcgtgctttattaggcggtaggatcaaaatgatgccttgcggtggagcaaagttggaagcctctattggttcatttttccacagtattgggatcaacattaaattgggctatggaatgactgaaacgactgcaacggtttcttgctggcaagataagggctttaacccaaattctatcgggacattaatgccaaatgcggaagtcaaaatcggtgaggaaaatgaaattctggtgcgtggtggaatggtaatgcgaggctactacaagaagcctgaagaaacggcaaaggcttttactgaagatggtttcttacgcacgggtgatgttggcgaaatggatagttgcggaaatttattcattactgaccgcttgaaagagctgatgaaaactttaaatgggaaatatatcgctccgcaatacattgagggcaaaatcggtaaagataagtttattgagcagattgctgtgattgcagatgcgaagaagtatgtttctgccttgattgtgccgtgttttgatagccttgaggaatatgcaaagcaacttaatatcaaatatcaggataggatcgagctgattaaacattctgacattattcagatgtttgaaagacgtatccacgagttgcaaaaagaactcccgagctttgagcaggtgaagaaatttactctcttgcctcaggcttttagtacggcaatggaagaaatcaccccgacgctgaaattacgtcgtaaagtgattatgcaacgctatcgggagcagattgaggagatgtataatgaacgttcattaacttaaatttcaatttacattgcattaaatgtagtttgaatattttcaaacatctgttttatgataaatataagttataattcgtctaactatatttctaagagtatgtcagtgaagcaagtacaattctatctattaagccaagtccaagcaggcgaactctccgcccaagaagctctagcgtgcgatttagcggcaaaagcgtggcgacaaggtaagcgagtgctgattgcttgtgaaaccgaagaacaggcattcaaccttgatgaagcactttgggcaagagaagcggatgattttgtaccacataatctgtccggcgaagtcaccacctatgcgaccccgattgaaatttcgtggaaaggcaaacgcaatgcccaacgccgagatgtattgatttcattacaaacagaattacccaattttattaacagcttcaatcaaattattgatttcgtgtcggttgatgaaacagaaaaggtccaagcgagggaacgttataaacaatatcgccaactaggttggcagttaagtaccgagcaagtttaaggatagagatgttccgcctagcacaacaagatgatttaactcgaattcttgaaatttataaccaggtgattgaaagacgcacagtgacggcagatttagttccagcaacgaaggaaagtcgccaaacgtggtttaatcagcaatctaaatcatgctaaatatccgatttaggtttatgaattagacggacaaattgttgcgtggtgtagtgatctacaccccaaaagttggactaaacaaccaactaattaaggtgcagattttttatggctaaatacacccaatcttttaaacaacaagtgatcgaattttatcttcaacataataaaaatcgctcattaactcgtcagcattttcaggttaaggaaaccatattaagatattggattaatcagtataatcacacctcgtgaaggaactacgccaccaatttccgtttgagattttattgcaattggttgatttaaaacggagtacgttcttttatcatcttgctgaaaaagacaataaaatggcaagttatcagtcgatattgaagcaaagcggcatcgtacaaagtatgtcgagaaagggaaattgtttggataacagtgcaatggaaagtttctttgggcgtttaaaaacggaatgttactttggtaaacggtttgagacctttgagcaactggaacaagctattcacgaatatattcattattacaatcatgagcgtattcaagtaaaattaaaaggactaagccctgtggaatacagaattcagtccttgaactaaatcagtctagctttttgggggcagatcagatgtgcccgccccgaaataacaaattaagaaggaagataacaatgcccccaatccaactctctcaaactcaatttgaacaacattttggttatgcgtcacagcaaaccgtttttgctccaggtcgtgtgaatattatcggtgaacataccgattataacgatggctttgtgatgccttgtgcgatcaactacggtatgtccgtgagttttgcgaaacgtgacgactccatttggcgtgtctatgcgattgatattaacgaaaccgatgcctttgatattaaaaaagaaattccacaaagtgaagataaatggaaaaactatgtgcgtggcgtggtgaaatatattcaagagcgttgccctgaatttattcaaggggctgatattgcaatgaccagtgatgtgccgatgtcttcagggttaagttcgtccgctgctcttgaaatttctatcggtaaaacttgccaagtgttaggtaatttaccgattagtctagcggagatcgccctaatcggacaacgtgccgagaataaatttgtcggtgcaaattgtggcaatatggatcaacttacttcggcattaggacaaaaagatcaccttgtgatgatcgactgtcgtagtttagacattagcccaacccccgtgccacaaggctatttcattgcgatcattaactctaacgtcaaacacgatttagtcacaggggaatataacagtcgccgtcaagagtgtgaatttgcggcacaattctttggcgttaaagccttaagagatgttagccctgaacaatttattgagcgagcggcagagttacaacagcttaatgaattagcctacaaacgtgcaaaacacgttatcagcgaaaatcatcgtgtactagaagcggttgaagccttgaaagccaacgatatgcaaaaattaggtgtattaatgggcgaatcccacgactcaatgcgtgatgattttgaaatcactatcccagaaattgactatttagttgaattagctcaagtcgctatcggcaaaaatggcggtgcaagaatgacaggcggtggcttcggcggttgtattgtctgcttagttccaaatgaaaaagtggaagcgttacgtaaacttatcgcagaaaactaccaaaaacaaaccggtattcaagaaactttctatgtttgcacagcaagtgatggggtgagagtggtttaaattatgcagtcataatatcatttctctcgcccgcttgcgggagaggggaagcaacataaagagagcaaatatgaaaatttatacccttgaaaacgatcatctcaaaatcactctatctgactttggtgcatcttggctttcttgcgtagttaaattgccaaatgaacaacgagaagtattagtaaccaccacgtctgaacgttggcaagagcaatcagcctatttcggtgcaacggtagggcgttatgccaaccgcattgcaaatggcacctttgagcttaatgggcaaaagtttattttggcaaaaaataatggcgaaaataatttacacggaggggaaatcggggcggataaatgtgtgtggcaggtgcaatcggcagatgaacaagcggtcacttttcacaaaattttcgccaatggtgaagaaggctttggcggtgaagtgactgcgactgtcatttatcgtttgaacggcaatcaacttgagattgaatttaatgcggtaagctctcaagatacaccgctctgcttcaccaaccacgcctatttcaatctttctaatgaaccgaccattcatcaacatagcctacaactcagtgcggagaaataccttcctgtcggtgctaatggcattccgaacgccccattaaaagctgttgaaggtacaagttttgatttccgcacagcaaaaatgatcggtcaagatttactggccgataccgatcaacaagctgttaaaggttatgaccacgcctttttacttgcaaaatcttgccaagatctgaccgcttgtcaggctgatgctgttttagcgtatgataatcttcgccttgaacttcgtacctccaaaccagcattgcaagtttatacagggaactggctgggcggacagcctaatttgacgagcggaagctatcctgattatgcaggagtcgccctagaacctgagtttttccctgatactccaaaccacccagaatggtggcactatggcggaatcagcaaagcaaacgagtcttatcaacatcatattcattatcgctttatcgtgggggaataaatgaaagttgagatctgtgtcgataatctagagtcggtcatcactgcaaatcaatttccgattgaccgtattgaactatgctctgcccttgcggttggcggcttaacaccgaatctaggttttattcagcaggctcaacaaatttcgactattcccctagccttgatgatccgtcctcgtgcgggtgattttctgtatagcgaagatgaaattcagataatgctcaacgatattgcaaccgccaagcagctaggcatacaagcggtcgtttttggggcgttatctgcaaatggtgagattgatttagcaacaacagaactattagttaaggcttcacaaggtatggagatcacctttcatcgagccttcgatctctgtaaagatcccattactgctcttgaacaactcattgacttaggttgtcattgtattttgacatcagggcaagcaacgactgcttttgatgggattcctgttattcagcagttagtcaaacaagcgaatgggcgtattcaaataatggctggctgtgggattaatgcagataacattaaacaaatcattgaacaaacccaagtgcctgaaattcatttttcagccaaagggcaacgtcaaagtctaatggattcaataagttcggcaagaatgggaacttcatcacaggataatgtgttagacattgccgattcacaaaaaattaaagggattttgaaatatatatcactgttgtagtgggggaagagccaaaagaaagcccctgcattattggcgcattagacctttgctaaaggtttgtaagaatggctcttcatcatatcttcgcctaccttttgggggtacaacccagtaaaggtaaattatatttgggttgtacaataggagaatcaaatcgattattttaaaaacgcctctaactcagccttatttggcagagcagacatagccccttttgctgttgttgctaaagcaccagacgcattcgccttgcggatcacttcaactaataccgcatcactctctttccagtttgacacttgcgataaaccagctaacaaaccgctcacaaaggcatcgccagccccagtggtatctactggttttaaggctttactggcaacaacttggctcttaccgtttaagtgataaatcgccccatctttacctaaagtgataataatcagcttctctggataaagtgaagtaacctctttcgttgcatcttcaagatttgtcgtattagtcaataaggtcaattcttcttcagagaatttcaacacgtccgccattgccacgacactattcaccacttttttcatttcatcaaggcttgaccaaagtgattcacgcaaatttggatcaaacgacactaatccgcccgcttgtttgacacgacgaatagcttcaatcgtagtagaacgtgaaggatcattgattaacgcaatcgaacagcagtgtaaccattcgccctgttggaaatttggcagatcattgacctctaagaactgatctgcactcggattgaccataaaggtaaaactacgctcaccttgatccaacccaacgattaccgtcgaagtacgttgttgtggatcaagtatcatctgctcggttgaaaccttttctgcttgcaaggtttgttgcataaacttacccagtgggtcattgcccacacgcccgataaatccagcctcaacccctaaacgagaaacaccgactgcaacattcgctggcgcaccgccagcacaacgcaaataatgattgtcgccatccggaattaaatcgacaacggcatcacctaacacccaaattctgctcataaattaacctttcaaagtctaaaaataatcttgtgcatagtagctaaaacggtttagttttgcaatttaagaacggatatatttagagaaaaaataagaggcagaaaaaaaagcgacttgtaaaagtcgctttttctaaatggagattattgattgttttgaacgtaatcaatcgcagattgaacagtagcgattttttctgcttcttcatctggaatttcgatatcgaattcttcttctaaagccatcactaactcaacagtgtcaagagagtctgcacctaaatcttcaatgaaagaagtttctggttttacatcttctgcttttgcaccaagttgatcaacgataattttttttacgcgttcttcaatgctcattttttgtttcctatgtgtataaattcgctaagtgcgagagttgaatagtgtaaaggaaaatttgctaaattcaagccttttaatacaagtcaaaccagcctttattttccacaacaccagaactaagtttcgctatcggttagcgaaaaatttgggtaattctaacattatgctcagggattatccatagtggatttttgatcgaatcggcatttctctaaaattacctaaaacaagcggccagatatgaggatttttttacaatttgcaaaattctttgtcgatctaaccgctttttgatttaaaataccgcccatttcgttttatagaattgatacaaataggataaataaatgcgtacaagtcaatatctcttttcaaccttgaaagaaaccccgaacgacgctcaagtcgttagccatcagctaatgttgcgtgcaggtatgatccgaccacttgcttctggtatgtacaactggttgccgaccgggttgcgtgtgttgaaaaaagtggaaaatattattcgcgaagagatgaataaaagcggtgctttagaagtggaaatgcccgtggtgcaacctgcggatttatgggttgaatctgagcgttgggaagattacggccctgagttactgcgttttaaagatcgtggcgaccgcccgttcgtattaggcccgacccacgaagaggtgattacggacttagtgcgtcgtgaagtgagttcatacaaacaacttccgttaaatctatatcaaatccaaaccaaattccgtgatgaagtgcgtccacgttttggggtaatgcgtgggcgtgagtttttaatgaaagacgcttactcgttccataccagcaaagagtcgcttcaagaaacctacgatgtgatgcaccaaacctatagcaatattttcactcgtttaggcttggatttccgtcctgttgcagcggacacggggtctatcggcggttcggcatcacacgaatttcaggtgttagctcaaagcggtgaagatgatgtggtgttctcaaccgagtcagattatgcggcaaatatcgagcttgcagaagcgattgctgtcggcgagcgtcaagccccaacggcagagatgacccttgtagatacgccaaatgcaaaaaccattgcagaactcgttgaacagttcaatctagcgattgaaaaaacggtgaaaaccttgattgttaaaggtgcaagcgaagaacagccgttagtggcattagttatccgtggcgatcacgaactcaatgaaatcaaagcggtgaaatgcgaagaagtggcggagccgtttgaatttgctgatgaagcggaaattaaagcgaaaatcggtgcaggtgtcggttcgttaggccctgtgaatatgccgattccagtaattatcgatagaagtgtggcgttaatgagtgactttggtgcaggggcgaacattgacggtaaacactacttcaacatcaactgggaacgtgatgtttctttaccaaaaattgcagatttgcgtaatgtggtagaaggcgacccaagcccagatggtaaaggtaccctattaattaaacgtggtatcgaagtagggcatattttccaacttggcacaaaatattctgaagcgatgaaagcgacagtacaaggggaagatggtcgtccgcaaacgatgattatgggttgctatggtatcggtgttactcgtgtcgttgctgcagcaattgaacagcaccacgatgaacgtgggatcatttggccaaccgatgcgattgcaccgttcactgttgcggttgtccctatgaatatgcacaagtctgaaagtgtccaaacctttgcagaagatctgtataaaaccttacgttcacaaggcgttgatgtgattttcgacgaccgtaaagaacgcccaggtgtgatgtttgccgatatggaactgatcggtgtgccacatatggtggtcatcggtgagaaaaatcttgaaaatggcgaaattgagtataaaaaccgccgtacaggtgagaaacagatgattgccaaagatcagttgttggatttcttgaaaggacggattaaccaataacagccattctaatttccaacatagatacaatgcatctcaatttttatgaggttacgaaattgagatgcagaacttgccacagtagacaaatagatgtataagtatcattatgtcttaatgtcgtcatttttgtttttgactaaatttttagaataatcatccaatatttgatttagcaagaaaaagattacgcaatatacgaatacaatatgttaaatattaataggtgttagccagttgacagacttttctatgttttcaagtgagttgagagtaggattgtcaacattataaataacgaaacagagtgaatgtaggtatccgccgatacgaattaagatttttgttgggtcgagtacacgcagtgtgccctacataaaacaatattcattttttaggagacaacatatgaaaaagtttctttttcctttgcaatgctgtgctgtgttatcaagccctagcctttttgccagtgatctttttgttacccttgaaaaatcatataacatcataaacttacagaaagccaaagcgcaaaatcctaccattgatggtagtaatgtagtcgttggtgttgttgattctttattcaatccagaacaccctagtttaaaagataaagtcattgaaatcggtggttataaaaattttgatgatatttataaaaatgatgcgagtagtatcggttcggcacaaaaagataacgctacatttcgacacggcacacacgttgcagggattttgttaggcagacatctaggtcgaactccaacctttgaaaataatggcgatccttatggtgttgcccctaatgcaaaattttatggagctgcgtttaaagaaagctcaaattttaattattggggcttaaatctatttgattttttcagtaaagatccaaaattacacatcgtcaatcatagttggggctataaggtttttccttatgaacaaaatatctctaactatgaacaagccttaaaaaccgtagaaagcaatgatccttacaatggttataacaacaaaaatgaagtagagcggatagttaaacttgccaaagaacgcaaagtattaaatgtgtttggttcaggcaatgatgggaaaaatagtgcgtctttgtttgaacttttacctcgttatgatgaagatattcgctcatttattgcagtgggaatgttagatgctgatggtatagatattgcctctgacggcaaaattattatcaaagaaaaacgagtaaatcagctttcttcaggtggagaaaggaccttgactttacaaggtatccacaaatattccaacggctttttaggctctcaggcttattccctaatggcacctggcagtaaaattgatgcggcaaatgccctttttgatgtgcataataagttaggtcgacaacagcaagaggaatttattcctttaactggcacaagccaagccgctccgatggttagcggtgcagctgctcttgtcgctcaaaaattcccattcttaaatggcaaacagatcgccgatgtgctgttatctaccgcaaatcaaaattacaccttgcctaaggtgattatcaaacagaaaccaaactatgatgcatttagtgtcatctatattgatcaggatataccgaaagacgaggctcaaatcaggcaagatatagcggaacttggatatagcgatacgcctgataaagataaagttacactcaataaaatcttaaccaacaaaacgctctatagcctaaaacgcgaagatttaatggggcagggcatacttgatgtacaaaaagccttaaacggcgtagcgacacttgacgcaaaccgtctaaatgtaagtgatattcaaagcccaacagggaaaaccgaagcctattatgtgattgatactcaaggacaaaatggcgaatttgctaacaatatcgagcaaaaaatgtgggacgacagcctacatcttgccacagcaaaaaattcccctgcagaacaaatgcgaggattgaatgttggatttattaaacaagggttagggcaactttctttccgtggtagcaacagctataaaggggcaactttggtgcgtggcggagagctaagtctaaaaagtggctcagcacttagcgaaagttcagtgtttgtggaacaaggcgggaccctaagcggaagcggtacgattgccaacaatttagacaataaaggcactgttattgctggcagtgatgatattgcgacattaacggtcggaaaaaactatactcatcacggcacagctaaactggtgttaaatttcaacactcaaggaaattcaaagctagttgcacaaaattacgacattaaaggcggaaaattactttatcgtcctttaagcggtcagttttatgccgcagggcagaaagtgcaaattgatttaggctcattagcaaatagccttaatcgttttgagagcgtggaaattctaagtaatggctcaacggaatttaaaatagcggattttaaactcgcttcaaatcacacggtaattaatgatgatacggttgaagaaaagcctgttactgaacctcagcctagcgataccgccaaagaagaaagctcttctgaagcagcttcaacggaacaaccaaatacggaagttaagcctaatgatacggcaaaagaagaaagtagctctgaaaccgtatcaacggaacagccgaacaacgtagaaaaagagaaggaaaaagttgaagcaatacctgctcaagacggtacacttatcgctgaagtcaaggttaagaaagaggctttttatattccaaatagtgacattggtgaagcgatttataccgcaagaacatctgcagatctcagccaagcatatcaagatttctttgtgaaactggataataccgccaatagacaagccgtattaaacagcattgctgaagatcatttgcctgatatgctcaacgacagcactatcaaaaccacccactttgctcaacaaaatctactgtttagcttaaccccaagctattttgttcagcgtttcaataccaacggaataaaaaattagtgggtggcgaagatatgttcttgtctaaattagtcaaacataatttggcacagaaaaaatatgcgttttacctgacaccaagctatcacatcacccaagcgaatgaatttaaagctaattcacacggattgcgtatgggtgtggcgacaaacattgataataaacaacagcttgcaatgagcctaaattatgaaaggggcaaaggcactttccattctgcgaactctcattcagacactttcaatgtcgcactgaattatgtatcgcattttgaccatttcaagctattgagtggcgtaaatttaggcaagtcgcaaaaccactatgagaaacagattgtgggagaaagggagaacatcacaggctcttatcaaaaccgctttgcgagtgcacagctaggcgttgccaaatcctataaacgagagaactttacgctatcgccactgacctatttcaactatgattttgtacatcaaaatgcatttaatgaaagcggtcggatttttacaaaatcatacgacagcgtgaattatcactcaacggctctgggggctgggcttttattaaactatgcaaccacattagataatgcccaaattcagttcgattcctatgccatctatcaacatagattaagcggtagaaattattgtaacaacgccaaatttagcgatatagcaaacagccacttcacgcaaacatatagactaaatccatctcttttgaccttaggtttaagctcacaagtaaattttagcaatggcttttttgctcagctggcattagagagtgcgcttacgccaaatcaaaaaacaagaaatattttagcaaccttaggatatcaattttagtgtaataggcagggcaaccgcatatgttgtccatttttcaacctacacaccgagcaacagctcatctcgaaattcatctgaccaaccagcagcggtcaatttccctttcatactctgctttttcgggtgtaatcgagccaagttcaacgctaatcgacgcaaaattgccagattttccgcaccccattcatcggtcacagcacattcgtcttctttatagaccacatctagcacccaatgggctttgttttccacttcccaatgccctcgcacgcacttcgccaatatttgaatatcaacatccaaactactgatataaaagactttttcttgtgattctttgtcattatctgaccgcttgcgacacacctccaacaccgattttatccccttccattcctccgctttgctcagccaatcactcactttcagcttacggtagtaacgctcatcaatttgtagtgatcaactaattcaacagtccccgataagttttttcagctgaaatcgggagcaaaccttgattatagctatgtgggcgaatgtggttgtagtacatcacataatcttttacatcgttgaccgcactttcaaaatcaacataaccaccatatgtcatccactcatatttaaaatttctaaaccaacgctccatcggtgcattatcccagcagttgccccgtcggctcatactttgcgttagcttgtgtttttgcacacactgggtaaattgcttactcccataaatactgccttggtctgagtgaaacagcattgttttcgtacgtttagtctgcaacatcgcgtgatttaacgcatcgacaaccaattgcgcatcgtggtgtcgactcaatttccaaccaacaacttgacggtttaacaggttaatcactaccgctaaatagcaccaaacaccattgactttaatgtacgtcgtatcgccacaaagcaccgtcgtttgtgcatcaggcgtaaattctcggttcaagtgattagcaaaaacttgccctatttctttatttcggttatgccatttttgtggttgtttgctaaataatccctgttgaatcattaggttgcgaatcaaccgcaaactagctcgaattcccttttgtctcaaacctgattgaacagttcgcttgctggcagattgacgacttgcctcaaaaatgaccttgatttcaatcgcaagtgcggtgtgtttttcgaccgcttgtcgccgtttcaaacgcgcataataggcactttctgacacaccaaataaggcacataaacgcttaatgccgtgcgattttaacgtcgtgaccgcttggtatcattgctctcgagagacattaaaatcgccgtagccttttttagaatttctttatcctcttccagctctttgatacggttttctaactctcgaatgcgttgttgttcaggactgattggctttgaacccagcaacacatagccctgacattcagtttgaacttgacttagccggcgacgcaacgctgtttcaccgatgtctagctctttgcaagcttgtgtaatagaatatttacgctcggtaatcaattttaccgcttcggatttaaattccgcgctaaaggttcttataggtcttcgcatttttatatcctcatgtttggttaaattttaccacttattgaggactgtgggattagtgtaccactacacattgaagttgatcgccataaaaaattaaaggcgtgcgttggcgtaaccaataggggacattatgttgttgacacagttttttgatgtcttgatgaataccatggtggagaaccgttcccgaataacgaaaagcaagatggatagttttttgtgttggcggaaggagaactatgtgatcttgccattttgcaatccattcattagattgcgttttaattataaatttgcccaaattatcgggtaaatcaatggattggtttaagcatatcggcaaaacaagatggctgatatcttgataaattggtgtgatgtgtaagtgccggcgatagcgacgaatcagcttgtcgcccaatttaaattccggataacgatcggcttgggcgaagatcacatcctgaataatttgtgccaattgtttgcttgagggcatgggtaaatcgcaattggccaaccacaaacgcagtaacgctttttgttttggtatagaaaaatgcacaaattggctaatgtcaaaagtgcggtcatttttttgatatttttgtaattcttgtaccagtaattcgtttaacaattgctgttgttctaagcaatgtttgtacggcttggtcaaaatgcgcccagcgttgtcgcaaggggagcaaaatttgatggcgcaaaagaagttgcggtcataacggttatcttgattgctttcatcttcgatccaaggcaaattttcgctattaacatattcttccagttcggtacgcgtgaattggagcagtgggcgaaaaatcggcacagaaaagaccgcactttgcatcggcatggcggacaagccttgcacgccgctgccacgttttagtgcgagaaaaaaggtttctgtttgatcttgctgatgatgggcggtcgtcaaaatatgatctgcacgcatataacgacgaatggcttggtaacgcgcttcgcgagcgcccacttcaacgcctaaacgtcgatcgacttggactttttccacgatcagtggaacgaacaattggcgacaaaggtgttgacaatgtgtcacccaatgatcggcgtttgggcttaaaccgtgatgaatatggatggcgctgagggaaaagtgcggtcgttttcgacagaattttgtcaataaagagagcaatgcggtggaatcaagtccaccgctaaaaccgacgagaaaatgtgtttgtgtcggttgatgttggctaacgatatgctcaaattttgcaaaaatatccatgctatattaagcaatttttaccgcttgataatggctgcgcggattaacgataaattctctagccgcgataatttgtagctcgtaaagcccggaatcatgagttatttgcatcacttcattcactgcattggcggtatgttcaaaggcttcaatatcggattttccgtttaacaaattcgccataaacaatccggcagttaaatcgcccacgccaacgggatctttagcaaaagtatgtaacgggcgactaatgtgccaaatgccttcttgattagcgagtagcatttcaaatttagtcgaatcttgtccaactttactcaaatgtttaaccaacactttttttggaccttgagctagaattactttaactgcttcaattgcttgggaaaaattatcaacagttaaaccacttaattcacgtaattcaactaaatttggtgtaataatatctgccgctttcatggcaattttaaccaaaccttcttttacaccatctgctacgatacaacctttatctggatgtcccataactggatcacagaggtaaaccgcatttggattgcgttgtttaacatagttaaccgcattgacaatttcttcgacctgatcagctgaaccgatatagccggaaatgattgcatcgcagcgatgtaattcgccaatttcatcaataccacgcacgatttcgccgatttgttctttgggtagcaccataccggtccatttggcatattgcgtatggttggagaattggacggtattcaaagcccatacatccaccccgagaagttgcattggaaaggttgcggatttattacccgcataaccatacacgacgtgagattgaatagaaatcaggtttttcatgtgaactcctttttaataataaatatcttttttataacgttaaaagagcggtcaaaataacctctctttttaacaaatcatttgattaacaataaccgtagctcatcaaacaagccgccgataatcgctttatcatcagcaaaggctcgatcaccggcaagttcttcaaaatcggtaaaaatgtgttcaatgtaatccaaggtgtaagggcggtttggatgacgcgccatgcgggaaacttgccaagcgtctaaatttgcaaaggttttttgtgttaattccacacttttcttttgcaagcgtgcaatttcatcatcaagattaattttatcgtcttgttcggcgacagaacgtagcgattcaattttggcttccaattctgcaataggtaattcaaaatctaagtattcttggctcatttgttcttcctaatattaaattcgcaccaaattgtaccgcactttagcaagattttcggcaaggtgcaaattgaaatgcattgtatgcgatcttgccctgaccgcttgtaagtgagttgatgtaaataggttgttcattacagcaaaaaagccgataatacacgacattttttagattttctgatgataaattcgtgggttaaatggttgagtatattctgttaattatcagtacggcgttaatcaataacttcgtgcttgtgaaattcttggggctttgtccgtttatgggcgtgtcgaaaaaggttgaaacggctatcggtatgggtatggcgacaaccttcgttttgacggtcgcttcgctttctgcttatttggtcgaaacctatctgcttattccccttgaagctcagtttttacgcaccttggtctttattttggtgattgcggtgattgtgcaattaactgaaatgatcgtacacaaaaccagctctgctctctatcgtttactgggtatctatttgccattagttactactaactgtgcggtattaggggtggcgttgttgaacgtgaatttatctaataatcttgtgcagtctgtgctttacggcttcggtgcggcggcagggttttcattagttttagtgcttttttcagctttgcgtgagcggttagtcgcggcagatgtgcctagagcctttcaaggtgcgtccattgcgttaattaccgcagggttgatgtcattagcctttatgggctttacaggtttggtaaaaatctaatgttcgatcattccattattctctatattttacttgcgattgcagcgattgccttgatttttggggcgatgttgggctattcatcggttaagctgaaagttgaagctgatccgattgttgagcagatcgatgctttgctaccacaaagtcaatgcgggcaatgtggctaccctggttgtaagccctatgcggaagcggtggcaaatggcgatgacattacgaaatgtatcccgggtgggcaagcaacggtggtgaaaatcgctgaattgcttggggttgatgtacctgaaacatcaggcgaagagcccgtggcaaaggtggcgtatattcacgaagagttgtgtatcggctgtaccaaatgcattgcagcttgccctgttgatgcgattgtcgggacaaacaaagcgatgcatacggtgattgccgatttttgtacagggtgtgaactctgtgttgccccttgcccgactgattgtattgaaatgataaaagtgaaacaaacgacacaaaactggaactggaaatttgatgcgaatttggtgatcccgattgtgaataccactgaagttgaaaagaaaattgtggttgggggaagtaatgcaagctgatgtattaagccgtattcgtgaaggaaaattatgggatttccctggcggtatccacccgcctgaaatgaaaaaacagtcgaaccaaaagccgatccgttcgttacatctgccgaaatttttctatgtgcctgtgttgcaacattcgggaacggctggggacgtgattgttcagcaaggggatttggtgctgaaagggcaagccttgacgaaaggggataattatcgccaactgcctgttcatagtccgacttcaggaaaagtggtcgctattcagccccacgtttcatcacatccgtctggcttacccgaattaaccattgtgattgaaacggacggcgaagataagtggatcgaacgtcagccgattgatgattttttaagcttaacaagcgatcagattattcaaaaagtttaccaagctgggatcgcaggcttaggcggtgcgatcttcccaacatcacacaaattacattttgccgataaacgctgtaagttgttgattattaacggtgcagaatgcgaaccttatatcacttgtgatgatcgtttaatgcaagattatgccgatgagatgatcgaaggtgtgcggattttacgctatgtgcttcgccctgaagaagtggtgatcgccattgaagataataaaccgaaagcgatacaagcggtcgaaaaggcattaaaaggtgcaaatgatattagcgtgcgagtgatcccgactaaatatccgtcgggggcaagcgatcagttggtgcaagtactgacagggctagaaattccgcaaggtaaacgaaccattgagatgggcattgtgatgcacaatgttggaacggcatttgcagtaaaacgtgcggtaatggacgatgagccgttaattgagcgagtggtgacgctgacgggcgataaaatccgcaataaaggcaacgtttgggcaaggctcggcacgccgattttgcatttgcttgaacaagtggattatcaagcggatgaacgttttcctgtctttttaggtggaccgatgatgggctttattttgccgtcactacaatcaccgattaccaaaacagcaaactgtattatcgcccctgatcactttgaatatgcaccgccagaaccagagcgaaattgtattcgttgttcaagctgttctgatgcttgtcctgtgggattgttaccgcaacaactttactggtttgcccgtgcggaagatcacgataaatcaaaggaatatcatttagatgcttgtatagagtgcggtgtttgtgcctacgtttgccctagttacattccgcttattcagtatttccgccaagaaaaagccaagatccaagaagtcgatcaaaaagccaaacaagcggaagaggcgaagatccgttttgaagctcgtgaagctcgtttaaataaagagaaagaagctcgcacggcgcgtattcaacaagctgcggaaaaacgtcgtgaagaagtggcaaatagtcaaggggaagatccagttaaagcagcacttgaacgcttaaaagcgaaaaaagcagaaacggctaccccagttcaaactaaagccaacggtgagccagataacagcgaattgatggcacaacgtaaggcaagacggttggcgaagcaggcggaagttagccctctccctgattctcgcgacattacgtcgcttgaatctgtccctctcccgcaagcgggcgaggggaatgatccacgcaaagcggcagttgcggcagctttagccagagcaaaagcgaagaaagaagcacagcaagcggtggtttctgatgaaaatgttgcaaaagctgaagttgcggaagacccaagaaaagcggcagttgcagcagccttagccagagcaaaagcgaagaaagaagcacagcaagcggcggtttctgatgaaaatgttgcaaaagctgaagttgcggaagatccaagaaaagcggcagttgcggcagccttagccagagcaaaagcgaagaaagaagcacaacaagcaacggtttccgatgaaaatgttgctaaagttgaagttgcggaagatccaagaaaagcagcagttgcagcagcgattgcaagtgcgaaggcgaaaaaagaagctcagaaatagcatagtagggacacactgcgtgtgtccgcattagttaaaccccgacaacgttgatttacggacacacgcagtgtgtccctacaaacattatttttatgaaagtgacacaagtaaatgaactaataattaaggaacacaaatgaacgaattatttcccccatttccgtggtcgtttttgtttattcaagacttgattggtactattgtttttgcgatttcaggggcgattgcggcacgccagcacaaaatggatattttcggtatgtttgtattagcttttgtgacaggcgtgggcggtggaaccttgcgagatgtgatgattagcagtacccctgtgttttggatgaaacagccgatttatgtgctgatgatttcagtggcggtagtgattgtggcaattttgaaaaatcagatcgaccgtgattattggaaaaaaggcttgttgatttttgatgcgattgggttgggggtgtttactgtaattggtgtgcaaaaagggctggattttggcttgcacccgttaatttgtgttgcattaggcggtgtaacaggctgttttggtgggcttattcgggatattttacgcaacgaagtgccggtcattttacaaaaagaagtgtatgtgaccgcaagtcttattggcggtattatttttattttgttccgtgatgctgggtttgaaagtaattggattgatgtggcaacggtaacgacggtcattgcaatccgaatgctcacgattaaatttaatatgcatttgccgaagatttagcaaatttagacgatataaaggaaacatttgatgtttaaaatgatcagttccccccactcgcattccaacaacttgacagcaaattttatgctgtgggtggttggtgctatgttgcctgcattggtggtgcagtggtatttttttggttacggggtattcattcaggcgagcttggcgattggcttggcggtggtaattgaaattgccgttgcaaaattgcgtggtaaagcgaccgctttctatttggcggatttgtcggggattttgaccgcattgattttggcgatggctattccgccctatgcaccttattgggtaattgtgattggcgtgattgtggcgttgttgctggcaaagcacgtttatggcggtttggggcagaatttatttaaccctgcaatgattggctatgcgttgttgttggtgtcattccctgtgcaaatgacggcgtggttgcctcctttggcgttattaaatgagccaccgacgttagcggatagtttttcgctgatttttgcaaatgtcaccacggacggctttaacgttcatcaacttattcaaagtgtcgatggcgtgtcgtctgccacagtgttagacggctcaaaacaggcgatgagtagcattaaagataatgtgaccttaggtattcagttagacaaactttttgcagatgtgttggtcggcggttgggggcaagtgaatttagcctttttgcttggtggtttgttattgatttataagcgaattattcattggcaaattcctgttgcgatgttgggggcttttgccttgttgagctttgcgacagattttgtgtcagaaacggctcgttggacggctcaagcccagttatttagtggggcgatgatgttcggggcattctttattgcaaccgatcctgtcaccgcttcaatcacgccaaaaggcaaactgattttcggggcgttggtcggtttgttgatttatttcattcgttattatggcaactaccctgacggcgtggcgtttgcggtgttgttggcaaacatctgtgtgccgttaatcgaccactatactcagcctcgtttatacggcacaaaattaggacggaaacaatgaaaacatcagtgattaccacacgttacgccctgattttaggggcgatagccttactatgtacggcggtttcaacgggcgtttatctgctgactaaaagtcgaattgatgcggttacggcagaacagcaacggcaattattattagaagttgtgccacaagtgcattttgataatgagctattagcaacttgcaaagtggttaaacttcctgaagcgccgtttttaaataaaatctatatggcaaaaaaaggctcggatctgaccgcttatgttattcaagctaccgctccagacggctattcgggcaatatagagctgttgatgggtattcagcctgacggcacggtattaggtgtacgaacccttgctcataaagaaacgccggggctaggcgataagattgaaacgcgtattagcgattggatttacagcttcaccaaccgcaaatttagcttagagaatgaaggcgaatgggcggtcaaaaaagacggtggtaccttcgatcaatttactggtgcgaccattacaccaagagcggtggtgaataatgttcgccaaagtgcaaaatgggtgattactcagttaaagcaaaagcctgaaatggtggaaggttttttgagttgtaaataatgaaaaatttagagataaaatatgcaagaaacccaaatccctattacccaaatagatgagacaccaaaagcggttgagccgtctgtttggaaaaatttatttacgcaaggtgtatggacaaataactcgactttagttcagctacttggattgtgtccgttgttggcggtgtcgaataatgtcacaaatgccttgggcttaggattggcaaccttattggttttgaccattacaaatacgatcatttccctgtttcgtaaggtaattccgcacgatatccgtattccgatttatgtgatgattattgcaactgcggtgacgactattcagttgttaatgaatgcctttgcctttcctgtatatcaatccttggggattttcgtgccgttgattgtgacaaactgtattgtcatcggtcgggcggaagcctttgcctccaaaaatagtatcgcccattcagcttttgatggctttgcgatggggttggggatgacgttaagccttgtggtgcttggggcgatacgagaaattattggtaacggtacactgtttgacggcttggatttattgctaggcagttgggcaaaagccttaagaatggatctgctacatttagattcaggcttgctattagccattttaccacctggggcatttattggtttgggattgattttggcggtgaaaaatattatcgaccgtaagaaatagggcaaaagaatgtcagaacgtgaaacatatcgagtaggttatcaacatcagtttcaaaaagcctttttacacccgaaatattggggaatttggctaggaatgttgggactagtgatcttggcttatgtgccatttcgttggcgtgataagctggcgacctgggtcggaaaaatcgttgctaaaaagctgaaagggaaaaagcaatatcatcgagcggatagcaatttacgctactgttttcctgattggtcggaagagaagcggtcagatgtgattgaaaaaatgtttattactgtcgctcaaacgatgttaggaattggtgaaattgcgttgcgttctgttgaacatattcaaaaacgtagtgagttttcaggtttggatattgtacgagaagcgagagtgaacggtaaaaacgtgattttactcgtgccacatacttggtcgattgatgcgtcggggattattatgcatacctacggaatgccaatggtttcaatgtataacccacatcataatccccttgtcgattggctttggaatcgcactcgcgaacgttttggcggtaaaatgcatacccgtcaaaatgggattaaaccctttttaaatgatgtgcgtaaagggtgtttgggttattttttgcccgatgaagacttcggtgaagccttgagtgtgtatgtgccattttttgcgactgaaaaagcaacattgccagggctagcgaaaatggctcgtgtggcaaatgcagtggtgatcccaatgttcccgatttacaatgcggaaaaaggcgcgtatcaaattgaaattttgccaccgcttgaatttgcaggtgatgagcaacagtcggcacggcaaatgaacgaagtgattgagtactttgtgccaaaaaatccagagcaatatgtctggatcttgcgtatcttgaaaactcgccgtgatggtcaagatatttacaagcggtaggatttgagagatttttgcaaatgaaaaccagcatctacgacaacccgattttcttcgaacgctatcttaaactgcgtgaaaatccgataagcctaaatgaagtggtggaaaagcctacgatgttttcgcttttacctgatctgaacggaaaaaaagtgctggatttaggttgcggggctggtgggcatttgttgcattatatggcaatgggggcgaaacaggttgtaggcttagatttatctcaatctatgcttgaacaagctgaaaaagattttgcaaaaaatagcgtagatccgaccgcttaccgtttttattgcttaccgatggaagccttatccaccatagcagaaagcgattttgatctggtgacaagctcttttgcttttcattatataaaagatttatctgccttattaacgcagatttctgccaaattaaaaccacaagggcaactgattttttcgcaagaacacccgattgtaacttgttttaaagaaggtgagcgttgggaaaaaatcaataagcaacaagtatcataccgcttaaattattaccgtgatgaaggtgagcgtgatcgtaattggtttcagcaatcttttaaaacttaccaccgcactaccgccaccattttaaatacccttattcaaagcaatttcaccattgagcaagtggaagagcctatgcttgccgatcaagttgaatggcacaacgaatttaaagatcttcaacatcgccccccattactgttcataaaatcagtgaaaaaataaggctttttctatccacaaagcctgtggataactttgtggattacttttttaaaacacgccaaacccttgataattcatagggtttttcctccctctttacgattgcttataaaatagcttttgtttaaaaatcaataggttatattttggctagaggttaaatgtaaaaaaaattagattttttcaccttttttgacttgacatcatttgcctgtgcaaaacttatcaaatatctatttatttattccactgaaataatttgtaaatctacctagatcattcagtagctaaggtttagaatgcctttagttttaatatttattcatttcggagcaaacaatggaaacgatcgttatcgttggcggcggtgcaggtggattagagcttgcaacttatttaggtaacaaattaggtaaaaagaaaaaggcaaatattattttggtggataaaaatattagccatttatggaaaccgttacttcatgaagttgcaacaggctctttagatgatggtactgatgctttaagttatcgtgcccatgcgaaaaatcatcactttgaatttcgtcaaggcacattaactcaagttaaaccagcagaaaaaatcattgtattagccccaatctatgatgaggcgggggaattattagtagcggaacgtaccattgtctatgataaattggttcttgcaatcggaagtcgctcaaatgattttaatacgcctggtgttgcagaacactgtattttcttagacagttcagagcaagcaaaagtattccataaacgtatgatggaattgtttttgaaattttcaaataataatgaaaaagaagttcatatcgctgttgttggtggtggggctacaggtattgaattatccgcagaactgtataatgcggttaaacatttaaattcttatggatatggtaagttagataatactagcttgaaggtgacattattagaagcaggagaacgcttgttgcctgcgttaccagaaagggtatcggcatctgcaattaaagagttacgtgcattgggtgtagatgtgttaaccaatactcctgttattcgtgcaactgcggagggattagttactaaatatgatgaaaactttaaagcagatctgatggtttgggcggcaggtgttaaagcccctgaaataacaaaaacatttggctttgaaactaatcgtattaatcaaattgcaatcaaaaatactttacagacattaactgatgagaacgtctatgtgattggtgactgtgcctttttgctacaagcagatggtaagcctgttcctcctagagcccaatcggcacatcaaatggcagcggtttgtggtaaaaatatcttagcacaattagaaaacaaacctttaaaggcttttatatttgatgataaaggctcgctaatttctttctctcgttttggtacagtaggtagtctaatggggaatttaactaaaggctcaatgtttattgaagggaagatcgcccgtatggcatacctttcactctatcgtatgcaccaagtggctctacacggttgtgtcaaaacagggttgattatgttggttggtagaattaatcgttttttaagaccaacgatgaagttgcattaaccctcaacaaattcgaagtagtttatgtagagctaaaggattaacatggcaagaatagacaactacgaacaacgttttggcggaattggtcgtctgtatacagctgaaggattagccaaattacgtcaatcgcacatttgtgtgattgggattggcggtgtcggatcttgggcggtggaagcgttggctcgttcaggtattggtaaattaaccttaattgatatggacgatatttgtgtcaccaacattaatcgccaaatccacgcaatgtcgggcgagatcggtaaattgaaaacggaagtgatgcaagagcggatcgctaaaatcaatcctgaatgtgaagtgacgatcattgatgattttcttacactggataatttaactgattatttgttaagagattatgattatgtgattgatgcgattgatagcgttagggtgaaagcagcgttaattgcattttgtaagcgtaataaaatcaagataatcaccacaggcggtgcaggtgggcaaactgatccaacgcaaattcagatcacggatttaagtaaaactattcaagatcctctagcgtctaaggtgcgtagcctattgcgaaaagagtataatttcagccaaaaccctaaacgtaaatttggtattgattgtgtattctctactcagccattgattttccctaaaatgagagagggctgtgaagtgtctgcaacaatgaattgtgccaatggttttggtgcagcgactatggttactgccacttttggcttttttgccgtttctcgagtaattgaaaaattattaagagaagcgaccgcttaaaatttgctattttatttaaagcaaacgtttgcattgagaagaaaaacaagataaaatgtagtcctagtgccaagaaaggaactagaaatgcaaccaaatcatataacagtatccaacacactttttcagctgagcttcgctattcaacgaagcttggctgtttttttatcgcattatttttccatttctagaagatctcatttttgagatttttttttgcccatatttttagaggataagcaatgagtcagttaattcgtactttaaaaagccatattcgtgatgaagtgattaaaaaagggggctgggttaattcccacgcgcacgcagatagagcattcactatgacacctgagaaaatcaaaatttatcaaaatgccaatttacaacagaaatgggatttagttgatgaagtcaaacgaaattcaagcgtagaagattattaccgccgttttagccaagcgattgagttgatgatttcacaaggggtaactgcatttgggactttcgttgatattgaccaagtttgcgaagaccgtgcgattttggcagcacataaagcacgcgaagtgtataaaaacgatattattctacgttttgcaaatcaaaccttaaaaggtgtaatcgaacctaatgctcgcaagtggtttgatattggttcagaaatggtggatatgattggcggcttaccttatcgtgatgaattggactatggaaaaggtttagaagcgatggatattttgatggataccgcaaaatcacaaggtaaaatgctgcacgttcacgtcgatcaatttaacaatcctaaagagaaagaaacagagcaactgtgtgataaagcggtggaacacggaatgcaagggcgtgtggtggctattcacgggatttcaatcggtgctcaccctagagagtatcgtcagatgctttataagaaaatgaaagccgttgatatgatgatgattgcttgtccgatggcgtggattgatagccctcgtaaagatgaagttttaccattccataatgctttaacgcctgctgatgagatgatcccagagggaattactgtggcaattggtacagataatatctgtgactatatggttcctctttgtgagggggatatgtggcaagaacttagcctactttccgcaggttgccgttttaccaatctcgaagaaatggcaaatattgcaagcgtgaatggacggaaggtgttggggttgatataacttccgttctaaatagtcatactctaaaagtatttaatacccactcaacaccttcgctggttctaatttagacgctctaattgcaggataaaggcttgcaattaggcttaaaattagggtggcgagaagtacccaaacaatgtctagccaatgaatttcgctcggtaagaagtcaataaaatagaccccgtctgagagcaatttcattccgattaaaccttcaaaccatttaataattgcagttaaattcattgatacaactacacctaatgccacgccgaataacgcccctttcatacctgaaattaaaccgtaccaaaggaaaatatgttgaataaagcggttgtttgcccctaaggttcgctgaatggcaatatcgccctgtttgtctttaactgccattactaaggtcgaaatgatgttaaagcatgccacaccaatcacaagcaccatcgcaatgtacatcactgtgcggatcagttgaatatcgttgtacatatagccaaatttatcaatccacgtttgcatatatagttgctgaggataattcgctaattcagggaacgtaatatctctgacttgaaacggctgtttcaccgctaattcaatccctgtatattggcttggtttcagctctaacagctcttgggctttcgcaatcggaagcagtgcgtaactgtgatcaagttggccgtctaaacgtaaaatacctgtcaccgttaagctaaaacgcaaaggttgagccaatttgctgtcgtcggttggttgtgacaataacagggtgacctcatcgccgacattaatatccaaagagcgagcaattccagcccctaaaactaaaccgccctcttgcttgaacgcttgccattgatcttgcggaataaattgggtgagctggctcacttgttcttgtttggttggatctattccccgaacctgtgcaatctttagctggctaccattttcaatcaagccagtaaagctgacaaacggcgataaagcggtcacatttgggttatcttttacgatatgctcaaggcgatcaccttgtgcaatggtcgctgatttactttcgttatacgccataatttcagcgtgaggaacaacggaaagcactcgttgatttagctctcgttcaaagccgttcatcgcacttaagccgataatcagcaccgcaacgcccaacgcaatgccgacactagaaaagagcgaaatcaacgacaccaagcgatttttctgtttgtcacgctgataacgccaactgataaaaaatggggtactcattagttatcctcacgcaatacgccgtcttgcataattaaacggcggtttagtttatgggctaaattcaagtcgtgggtcactaacaggaaagcaatctgctgttcttgatttaaacgctgaattagctcaaaaatactctcggttgttttttggtcgagattaccggtcggttcatcagcaagaaccaacgcagggttattcaccaacgcacgagcaatcgcaacacgctggcgttcaccgcccgataacgccgaaggtcgatgggtaattcgatgagccaatccgaccgcttgtaacattttttctgcccgatctttggcttctgttttgttttgttgcccgattaacattggcatcatcacattttccaacgcagagaaatccgccattaagtgatgaaattgatagacaaagcccagatgttgattgcgtagttttgcaagagcattgctactgagcttctgcaatgattgccctttgataaacacctcgccgtcactcggttgatctaaaccgccaagggtgtgtaacaaggtacttttgcctgagccagagctaccgacaatcgccacaagttcgcctgcgttcattgaaaaggagacatttttaagcacctgagtggcatttccgccctcttggtaaaatttgctgatattttcacagcgaagaagttcgtttgaagacattttgttttatttttcggaaagaaattattgtgtttcatcttaaacaaaaaacgtggtagatgctacatgaaaacagtaaaattcaatcatacttatgtgatcagattagacttgtaggagcttccccgctattttgctatagcatattggatttattggagggataaaacttactatataatgttctatccatttatggggagctctctgctcgttgagtttaattattgattaaatttgacggatatgagtactcataataagatgaaaacctttttattcattaatctttgaataagaattgttctttcccaatttcaaattggggggttgttttttatactaaatgggaatttatgaaaaaaattgaacgtctgtttgcaaataatcatgcttgggcaactcaaatgaaagatgagcattcagattattttaaacagctagcagaacatcagaaacctagttttttatggattggatgttcagatagtcgagttcctgctgagaagttgacgggattagagccaggagaactattcgttcatagaaatgtggggaatcttgtcattcacaccgatttaaattgtctttcagttgtacaatatgctgtggatgtgctggatatcgaacatattattatttgtggacataccaactgtggcggtattaaggctgcaattggaatggaagatcatggtttaattagcaattggctactgcatattcgagatctatggtttaaacatagccatcttcttggaaaaatatctcccgaacataggggggatatgttagttcgtttgaatgtagcggaacaggtttataatttgggacgttcaactattgttaaatcagcttgggagaggggaaaaaaactctctattcatggttgggtctatgatgttaatgatgggttcttaaatgatcaaggtgttatggcgacaagtcgagagagcttagagatcacttatcgtaatgcaatcgcaaaactattgagagagggtgacaataactcatagtcaatttttatccttcaatatttttttacctatggtatttagggaggggaattatgaaaacagcattggtgacaggagtaacttctggattcggtttagctatttgtcgaacgttgattcaggcaggttatagagttattggtacagggagacgtattgaacggttaaagatgttaaaagatgaattcccagatcatttttttccgcttgcttttgatattcgtaatgcagatgaaacgattcatgctctaaataatcgaccagattgttggaaacatgtcgatttattagtgaataatgctggtttggcattaggtttagatgctgcatatgaagcagatttagatgattggtaccaaatgattgataccaatatcaaaggggtggttactatcacccatttgattttaccaggaatggtagaaagaaatactgggcatattattaatttgggatcaatagctggcacatatgcttatccaggaggtaacgtttatgaggggacgaaggcttttttgaaacaatttagtttaaatttaagagcggatctaattgggacagcaatacgtgtgagtaatgtcgaaccggggttatgtggtgatactgagttttcgtatgtccgctttaaaggtgataaggaaaaggtatctaaactttatgaaaatgtagagtatttaaaacccgaagatattgcagaaatagtattgtggctgaatcaacaacctaatcatgtgaatgtaaatagcattgaaatcatgcctgtatcacaaagtttttcatcactcatggtacataaatcctagttcaattatagagagttgaaaaatgataacgacggtatacaccttaccatcacgctttaaaagcccgaatacagcggttttacccacagctccacgatctcgtttacctttgcgagtgccgcaaaaatagctttcatcggcttcaatttcaccttcaaacatctccatatgtgggctgttttgatagataagcaatcgcagacgatagaagtaataggctgctgtcgttttatttacatttaccaattcagccgctgttcgagcagtgacacctgccacaaacagctcaatgagtttattttgtttatgctgacttagacgactttttctcatttggttattttaacctaaaatagagcttttagtcattatctaggacagccccctatgtatttcaacaaaaatatgcaatcccttgctttgatggaatgtatccagttataggctcttggattgttggggatactgcttgtggtataggtattcgagaagattttaccgcaattacagggaatgatagccactttgtaccacattattttgtagaataatgcttaaataagcaaacgattacgtattttacattctatcccttgagtaatcctaagattttggctacactctgaacgaaatagccaagacttcctatctctttgtgcatttagtactgtcggttgccttcgtcgatttcatttccatcttatttcctgaaattctttattctattaagaggcactatgctcgaacgtttgtttcaattaaaagaaaaaggcagtaatgtcaaaactgaaattgtggcagggatcaccacattctttacgatggtttatatcgttttcgtcaacccatctattttaggtgtggctggtatggatacccaagttgtctttgttaccacctgtttaatcgccgcttttggtactattgcgatgggtttatttagtaacttgccgatcgctcttgcccctgcaatgggattgaatgccttttttgcatttgtcgtcgttcaaaaactcggctatacgtggcagacaggaatgggggcaatcttctggggctctgtcggtctatctattctcacgatattgcaagttcgttactggtttatgtcagccattccacttggtttacgtgtgggtattggtgctggtatcggcttatttattgcgttaatcggctttaaaaatatggggcttgttgtcgcaaaccctgcgaccttagtggcgttaggtgaattgcacgatccaaaagtcttaatgggtattttaggcttctttattatcgtggtactggctgcaaaaggtattcattctggcgtattaatttcaatcgttgttgtgacggcattagcgttaatctttgatcctgatgtcaaattctcaggcgtgatttcaataccaccaagccttgaagctgttgttggacaagtcgatatcgcaggggcattagataccgcattgctggggattatcttttcctttatgttggttaacttgtttgactcatcaggaacattaattgcggttacgaataaagctggaattgccgatgaacaaggtcgcttcccaaaaatgaaacaggcactttatgtcgatagcgtcagcgctatggcgggttcttatatgggaacatcagcgatcagtacctatattgaaagtggttctggggtttctgttggtggacgcacaggtttaactgctgtcgtggtgggcgtgcttttcctattaacgatcttcttttcaccgcttgcagctgttgtgcctacttatgcaacggctggtgctttagtgtttgtcggcattttaatggcttcaagtttaattgaagtaaaatgggacgacttaaccgaagcgacacctgcatttattactacagcgatgatgccatttacctattcaattactgaagggattgcctttggtttcattagctattgcattatgaagctctgtacaggtcgagtaaaagagattaaccctgctgttgcggtggtttcactgctctttattgctaaatttgtttgggttggataatttcgtcctgtgggcacacgttgtgtgctcacattatctctatgcaatatcactttctgcctttacaaaatttgcctatctaattaatttttttgacaaaaaaatctgcaaacgtttgcatttttctatataatgtccgcctgagctatgtcttgtagcttggcgactatcaaacattattagagagttgaaaaatgacaacagaaaatatcagtacgcctaaacaggcgttcgttggcttacaaatgcttttcgttgcatttggagcattggttctaatgccattgattacaggcttagatcctaacacagcacttcttactgccggtatcggtactttaatcttccaaatctgcactaaaggacaagttcctattttccttgcttcttcttttgcgtttattgcacccattcaatatggcgttcagcagtggggaatccctgtcacaatggggggaattgttttctctggtttaatttattttgtcctttccgcattagttaaatttaaaggtgtggcaattttagataagttatttccacctgttgtagttggtccagtaatcatcattatcggtttaggcttagcacccgtcggtgtagatatggctatcggtaaaggcactgatattccttatgcaacggcagttactgtttcaatgattaccctaattaccacactaattgtggctgtatttaccaaaggtatgatgaaacttgtgccgattatgttcgcaattgtggtcggctatattgtgtcactcttctttggtttagtgaatttccaacctgtttatgatgcggcgtggttcagcctgccaaaattaacaacacctgaatttaaacttgaagcaatcctctacttacttccaatcgcacttgcaccagcagtagaacacgttggtggtattatggcgattagctctgttacagggaaaaacttcctaagcaaaccaggtttacaccgtacacttttaggtgatggcgtggcaacatctgctgctgcaatgctaggcggcccaccaaatacaacctatgcggaagtaacaggtgcagtaatgctaacgaaaaacttcaatccaaaagtgatgacttgggcggcttgttgggctattgcaatctctttctgcggaaaagtcggtgcattgctacaaaccattccaggtgtcgtgatgggcggtattatgatgttagtgttcggctctatcgcagcagtaggtatgagtaccttaattcgtgcgaaagtagatatgagcgaagctcgcaatctctgtatcgtgtctgtagtaatgacatttggtatcggcggaatgctaattaacgttggtgagttctcgttaaaaggtattagcctctgtgcgattgtggcaattatcttaaatttagtattaccaaaagagaaaactgaaaaagcagaataaattcattggtaaaatttagaaaaatcaaaccgcttgttttgtaaaacaagcggttttttattgtcagaatttttctatacaacgcgaacaaacaaggtaatgccatcaaccttttctacttgaatgttatcgccaacttgtaatgcgttgccaatcactcgccaagtcgtgtcgccaaattttcctcttgcaacaccgctgtcgagaacttcaacgacagtcccctgtaagccgatcattgcgtgatctcgggcatttaaatcggcttgttgatcttcttgctgatctttactgtgctgatatttccaccaagcgaggctaaacagaatagctaagatcgcaaaaatagtggcttgccagcccaattcgatattagggaataatatgagtagtattgcaacaataatcgctgcaaatccccaccacattataaagatccctgcaatgagagtttctagaataagcaaaataaaaccaaaaatcagccaagcagtccagcccgaaagccattccatatttcccccttatttcttatcgcctttaagtaattcagcaatgccagccacagatccgattaaattgcctgcctctagtggcattaagacaactttactgttgtcagcagcaccaatttcacgcagtgcttcagtgtatttttgtgcaataaagtaattaattgctttagtgtcaccgcttgtaatcgcttcagacaccatttgtgttgcttttgcttccgcttctgccgcacgttcacgagcctctgcttgtaagaatgcctcttgtcgttcaccttctgcttttagaatgcgagcttgtttttccccttctgcacgcaaaatttctgcttgacggatcccttctgcttctaaaatatcggcacgtttattacgctctgctttcatttgtgcattcattgcttcaactagctctttgggcggacgcacatctctaatttcaatacgcgttactttgacaccccaaatgtttgcggcttcatcgacaatggctaataatctaccgttaatcaaatctcgctgtgaaagcatatcatctaaatccatagaaccgagtaccgtacgcatattggtcatcgttaaattgatgattgcctgctctaaatgattaacttcataagcagcacgacgagcatcgatcacctgaacaaagcaaacggcatcaattgccacactcgcattatctttggaaatcacttcttgtgatggaatatctagcacttgttccatcatattgattttacgtccaaccctatcaataaaaggaataacaatattcaaccctggggttaatgttttggtataacgcccaaaacgttcaatagtccaatgaaatccctgcggcacggttttaattgacgatagtaaaatggcaatggtcaaaatgacaaagacgaagggtaaaatcatcaattcagataacatcatattctccttaatataggttaaacaattgcctatatattagtctatttttcctgaatttctagggatttttacaatttcagcgtataattttgagtattttcaaatagatactttaaaacgatgaaaccagcaacagcgacgatcaacggtagtgccttacgacataatatgcgtttaattaaatctttggctcctcacagtaaaatctgtgcggtagtcaaagccaatgcttacgggcaaggtattcgagccgtgattaagaatttagaagatcaggtagaggcttttggtgttgctcgcattaaagaagcattgactattcaagaaagtggctatgccggtaaaattttattgcttgaaggtttttttgatcgtgaagaattattaaaaaccctttcccgtcgtttcgatacagttattcattgccttgagcaacttgagctgctcgaaaatgtggctcaagagtggcaagcggaaaagcagaaaggtttttggcagcgtaaaaccaaaatttatttcccgattaccgtttggcttaagattgatacaggtatgcatcgtttaggtattcaccccgaacaagttgcagaattttatcaacgtttaaccgcttgtcctctcgtagaatgtattcactttgtcagccattttagtcgagcggatgagcttgattgtgattataccgaaaagcagatcgctacttttgaaacagtcagtcaagagtacaaggttgagcgtagtatttctgcttcaagcggtattctttattggaagcaagcccattatgattgggttcgccctggcattattatgtacggcatttctccgcacacaacgccaattattgatttaggatttaaacccgtaatgacattatcttcttctctgatcgcggttcgcagtcacaaagcaggtgagcctgtgggctatggcggatcttgggtaagtgataaagacacgaaaattggtgtggttgctattggttatggcgatggctaccctcgaaatgctcctgaaggtacgcctgtttttgttaatgggcgtaaggttccgattgttggacgagtttcgatggatatgatgactgttgatcttgggattgatagccaagataaagtgggcgatgaggttgagctttggggggagcgtttgcttattgaagaggttgccgaagcgataggttcaattaactatgaattaatcacaaaattaacaccaagggtgattactgaatataaagagagtaatgctatataacataaagagcttagcttgaatttaaactaagctcttctgctgaattgaatagtttgcaataaagactttaggtagtacgattttgaggattagttaacagtcactctcgcaaacttacgtttaccgacttggtaaacaaaagtccctttctgtgcattttgtttcacatcatcgactttttcaccgtcaattttcacgccaccttgctgtgcggaacggattgcttcagaagttgaaggcactaagcctgcttcttttaataatgtcgctaaaccgatttcgccttcaaaggtaaattcaggcatttcgtccggcattgcacctttttggaagcggttgataaactcttgttccgccgcatctgcatctgcttcagaatggaaacgagcgataatctctttcgccaataaaattttcacatcacgtgggtttttacctgcttccacatcggcttttaactgtgcaatttcagttaatggacggaatgaaagtaagttgtaccaatcccacattaattcatcagaaatcgacataattttgccgaacatttcgtttggtacttcggtaacgccgatgtagttaccaagggatttcgacatttttttctcgccatctaagccaacaagcagtggtaatgtcattgcgacctgtggtttctgccctgccgctttttgtaactcacgaccgatcaataagttaaaggtttggtctgtaccgccaagctcaatatccgcttctaatgccacagagtcgtgaccttgcaataatgggtagataaattcgtgaatagcgatagattggttgttagcaaaacgttttttgaagtcatcacgctctaacatacgagccacagtgtagtttgacgctaggcgaatcataccaaccgtacccaattcgcctaaccaatcagagttaaacacaatacgggttttttgtgggtctaaaattttatagatctgctctttataagtttcagcgttgcgtagtacatcttcacgagaaagtggcggacgagttgtatttttacctgatggatcgcccactgttgctgtaaagtcgccaattaagaaaatcacctcgtgaccaaaattttggaattggcgaagtttatttaatacgaccgtatgccctaagtgaatatctggagcggtcggatctgccccaagttttacgcgtaacggacgattttcttttaatttctcaattaaatctgcttctgaataaacatcttctacgccacgtttaagttcagcgagaatggtttcaatagattgtgtcatcattattccttttactatatgcgaaaaatactggctattatagcggagaacgaggaaaaaaggcgaaaaaaacgcctcattttgtgggggaatgaggcgtaagagttggagtgattacctattatttttggaagtggctagatgataataattatcataaaggtagacaagtttgtttacataattttacaaatttaagtgttttttcaaaattttattatttggtgaatactattcaaaatccgcttatccgaaatcggatatttggtgccaagctgttgggcaaacaggctgacacgcaactcttcaatcatataacgaatttctaagacttcatcggaaatcggtttggattttggcagtttcgccaacagttgttgataggcgttttgcacctgttccactcgcaacattttggatcggtcagcattgctatccaccaccaacttatctaaccgcttgtcgatagcggtgagatagcggtgtaaatctgcaaggcgtttgtagcccgttttggtgacaaaatcggggtaaatcaaaccgtcaatttgtgctttaatgtctgacagggcaaatgccatcgtgaaatccagcttaccttttagacgtttgttgatttcataggcaagggtaagatttttctcaacctgtttagcaatttcgaccgtggtgtcgtttaaattcgccctaacgtagtcgtgcagggcgttaaatttttcttccgaccacacaaagccaccaaactcctccatcaacttatccaccgcacaggcgatacagtcgtcaatcagttctagcaccttgccgaacggagcaaaatataaaccaagtttggttttattcggcagtttttcgtgcagatatttaatcggcgacggcacgtttagcaataacaatcggcgtaagcctgcttgcattgctttggcttgctcaaattccgtttcaaacagcttgatcccaacggcatctttttcatcgacaatcgcagggtaggcttttacgctaaaatgctgttttttctgctcgtaaaattgtggcaaatcggcaaaattccacaaatgcacaccgctttgctcaatgccgtcatcggcaatgttagacagagtattttgcacttcgtctttcaagttaaattttagctcatcaagattttcactttccgcaaggcttttacctttttcatcaatcacacggaagctgatccgcaaatgcggtggcagttggtttaaatcccactgttcaggctcaactaaaacccctgtcattcggcgaagttcataactcaaactttccaacaatggttttttaaacggctctgcacgagataaaaacgcttccgcatagtttggtgcgggtacaaaactacggcgaatagctttcggtagcgatttaatcaatgcaatgataagctcttgacgtagtcctggaacgtgccaatcaaagccgtgcgtatccacttggttcagcaacggtaacggaatatgtaccgtcacgccgtccgcttgcgagccgatttcaaattgatagatcagcttcaacttaagcgaaccttgataccagaaatttgggaagtctaattcgctgactttgtttgcattatcattcatcaagaacgatttttcaaagttcagcagttcaggatctttctgtgacgcttttttccaccagctgtcaaaatgtttgctggaaacgacatctgtgccgatccgctgatcgtaaaattcaagcagcacttgctcgtccactaaaatatctcgacggcgagatttatgttccaactcttcgatctctttgatcaagcggttattttctttgaaaaatttgtaattattgtgccattcaccttccaccaacgctgagcggataaaaatttcacggctgacaacaggatcgattgccccatacatcacaggacggctggcgataatcggaataccgtagagcgagactttttcatcggcaaccaccgccccttttgatttcgcccaacgtggttcgctgtagctggatttggttaagtgtttggcaagcggttcaacccattcaggctcaattcgtgccaccattcgcccccacaatttagtggtttcaaccaattctgccgccattacccatttcggctgttttttgaaaagcacggaattagggaacagataaaaatgtgcatttcttgcccctaaatagtgcattttttcgttgtctttcaagccgatatgcgacaataaacccgataataaagcggtatgaatttgctgataatttgcaggttcactgttaatcggcaagcccatttcacgcaccgcaaggcgaagctgatgataaatatcctgccactcacgcactcgcagatagttgagataatctttttggcagagcctacggaactgatttttggtgagttccttttgttgctcttgaataaaatgccacaggttcacaaaggctaaaaaatcgctctctttgtcggcaaaacggcgatgtttatcatctgccgattgctgtttttcctgcggacgttcacgaggatcttgaatagataacgccgatacgatcatcatcacttcgtgcaaactgccgtttttagccgcttcgatcaccatacgacctagacggggatcgataggcagttgggcgagttggcgaccgatgtttgttaatttctgtagggacgcactgcgtgcgtccgcggacacacgcagtgcgtccctacccaaagcacctaattcttctaaaagacgaataccatcttgaatatgccgttgatctggcgcatctacaaacggaaacgaagcaatatccgtcaaacccaacgccgtcatctgcaagataaccgaagccaaatttgtccgcaaaatttcaggatcggtaaactgcggacgggcgttaaaatcctcttccgaatacaagcggatacatatcccttccgaaatacgcccgcaacgccctttacgctggttggcggaggcttgagaaatcggctcaatcggcaaacgctgaactttggtacgatagctataacgggaaatgcgagccgttcctgtatcaatcacatatttgatatttgggatagtcagcgaggtttccgccacgttagtcgcgagaataatgcggtttagattacttggattaaaaatgcgttgctgttctgcggcagataaacgggcatataacggtaaaatttccgtatggcgaagttcctgcttctgcaaggcttcggcagtatcacgaatttctcgctcgccgttcataaaaatcaaaatatcgccccgaccttctgcttgcagttcgtccaccgcattgagaatgccttgcagttggtcttgatcatcttcttccacaatcgggcgataacgcacttccacaggataagttctgcctgatacttcaataattggtgcgttgttgaaatgtttagaaaaacgttccacatcaatggttgccgatgtgatgatcaccttcaaatcagggtgttttgctaaaatttgtttgagatagccgagaataaaatcattgttaagcgaacgttcgtgggcttcgtcaataattagcgtatcgtattgattgagatagcggtcgttttggatttcggcaagcagaataccgtccgtcatcaatttgacgagggtgttatcgctaatctgatcgttaaagcggattttataaccgatggttgaaccaagttctgacttcaattcttctgcaatgcgtgtcgccaccgagcgagccgcgatacgtctaggttgcgtatgcccgattagtcctttcaccccacgccctagttccaaacacatttttggcaactgcgtagttttacccgaccccgtttccccagcaatcaccaccacttgatgttcggcaatcagttttaagatctcgtcacggcgagcggaaacaggcagatcagggtactcaattttcagttgttcggcttgttgtttacgcgtgagatagcgacttttacaagcggtcaaatccacctcaatttctgcaatgatggcttgtttagcgttttcatttttgatattcgccaacccacgaatacgcctggctaaacggcgagcatcaattaaagtggtatcttgcagttggttaagtaagtttttttgttctgctgtaagcggttggtttttatggtttttttgcatatttcaatggtaaattacgattttcctatgatgagcgacaaaatcccagcagcaattaacggaccaacaggtacgccttttaagaaagcaacaccgataatagtgccgattaataaccctgtgactagcacaggttggttgcccattagggttacgccacgtccgccaagccaagcaactactatgccagcaataatagcaacgatcattttccaattaatcggttgaacaagttcaggcaaggcaattcgccctgatacaagaggggcaagtacgccgatagtcagaatgataatgccgattttgataccatattgttctaaataaggcacatattttgataataacgtttgttgcataatcaataatacagcagcagaaatggttacagcactattttgactgaaaataccgagtaagataagtgcaacaagcagtagggcaacagaattaaattgtagtgacataggtttatttaaggtgaaaatcccttacttgataaacaaataagggattgtgttttgctttagttagttgataaatcgcattagtcccattaatacaccaagaccagcaaacataaatccagccattttatacattgatgttgtcaaacgtacttcaagctgagcaatttcttgctttaattcagattttagttcgttaatactctcttttaaatctgacttattgactaatccactttgactttgctcaagtgcttcatctaacgctgttgcaaacgcctcagcaacctcaggtggttgattagcttcttgtagcttttttacaaagcgaagtttatcaaatcgaatactcatagttgagtccattttttattccctttgtgattagtgttatcaaaaaataacataaatcacgcaggtatttggggctaattttgtgatcgccgtcgaaaaacagaaaattaactagcgaccattaccattgctggacggataacacgtccgtgtagcgtgtaacctttttgtaagactacactaatatggttggcttcaatgccttcagctggttgcattgaaattgcttggtgtagctctgggttaaatgcttcacccaccacgccgactgcttcaacaccaaagttatttaaggttgaaaccaagcctttatgggttaattctacgcctgattttacgctttcatcaaccccttcaagagcctgtaaaccacgctctaggttatcgacaacagtcagcatctctttagagaatttttctaaggcaaatttatgggctttttctacatcttgctctgcacggcggcgaatattttcgacttccgctcttgcacgcagttgaatatcttgttcacgcttatccgcttcagcaatataggcttctagctcttgtacacgagcaatagcttcttcaagcggatcgatttcattattttgttgcaactcaggttcaacatcttgtgtttgagcttcctgagcctcttgtgctaattcagttgcttggctaacgtcttgttctacttgttctttttcagtttggtttgtcattgtgtatcctcaaattttgacttcgcaaatttttgcactaaaacgaccgctaatatagcgacaaattacgggatttcaaggcttaaatgattattttccattgttatctgttttctttggtctgttttcgctataatcgccacaattttttccaaattttataagaaggataactagatatgatgcgttctcattattgcggtgtgttaaaccgtactcacgttggtgagcaagtaacattaagcggttgggtacaccgtgtccgtaaccttggtcgttttatttttatgcaaattcgtgaccgtgaagggatcgtgcaggttttctttgatgagaaagatgaagccttattcaaacaagcctctgcattgcgtgcggaagcctgcgtgcaaattaaaggtgaagtgattgctcgtgatacatctcaaattaataaagagatggcaacaggtgaaattgaagtgttggtcaaagaacttgtggtatataacaattcagacgtattaccgctcgatttcaatcagaacaacaccgaagaacagcgtttaaaataccgttacttagatttacgccgtcctgaaatggcggaacgtttgaaaacccgtgcaaaaattaccagctttgttcgtcgttatatggacgacaatggttttctggacattgaaactccaatgctcaccaaagcaactcctgaaggtgcgcgtgactatttagtgccaagccgtgtgcataaaggcaaattctatgcgttaccgcaatcaccgcaattatttaaacagttgctgatgatgtcaggttttgaccgttactaccaaatcgtcaaatgtttccgtgatgaagatttgcgtgcagatcgtcagcctgaatttacccaaatcgatgtggaaaccacctttatgaccgcccctgaagtgcgtgcgatgatggaaaaaatgatccgcggcttgtggttagatcgtttaaatgttgatttaggcgagttcccacaaatgacttttgcagaagcaatgcgtcgttatggttcagacaaacccgatctgcgtaacccgttagaattagttgatgtggcggatattctaaaagatgttgaatttaaagtattcagtggtccagcaaacgatcctgaagggcgtgttgcggtcattcgtgtgccgaatggtgcgggaattacccgtaaacagattgatgaatatactcaatttgttgggaactatggtgcaaaaggcttagcgtgggcaaaagtgaatgatgtaaacgctggcttagaaggcttacaaagcccgattgctaagttcttaactgatgatgtggttaaagcgttactcactcgtgtcaatgcacagaacggcgatatcatcttctttggtgcggacagtgaaaaagtcgttacggatgcaatgggtgcgttacgtttgaaagtaggacgtgatttaggtttaacggatctcaccgcttggaaaccgctttgggttgtcgatttcccaatgtttgaaaaagatgatgagggtaactggtcagcaatgcaccacccattcaccgcaccaaaagatttaagccctgaagagcttgtgcaagatccaaaaggtgcagtagcaaatgcttacgatatggtgattaacggctatgaagtaggcggtggctctgtgcgtattttcgacccgaaaatgcaacaaacggtattcggtattttaggcattaacgaagaagaacaaaaagagaaattcggcttcttgttagacgcattaaaatttggtacaccaccacacgcaggcttggcgttcggtttagaccgtttaacgatgttaattactggcacagaaaatatccgtgatgtgattgccttcccgaaaacaacggcggcagcttgcttgatgaccgatgcaccaagtttcggtaacccgaaagcgttggcggagttggcaattcagacaacgctagaaaaagaatcgtaagctgtatccgatttgagagtgtggatttttgcactatttaattattaagggctgataatgggttagagccagagtcagctttttgttcaattaaagtattctttattgagtgttgtgatgatatttaaattacttaggataatcttcttttacaggattgtatttttgcctacgtagaccctatcccaaattctgtgtaaacacccatttcaacttaacggtgatcgtctaagcgatcaccaaaatcaatcataaatcgattcatcgccagtttccagttctgaatcggcattgtccatttttttgatgcatctttacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaatcttcgttttagataaccaagatggtcggtcagttcatcatttaacgcggcctcgacggtaattttcttgagcatccgtgaaaattgattgaggtcttctggtgtttttaggtttttggcaaattccgctgccaaggcgtgaagttgtttttcgttcataataaaatacctgtgtctgaatgtattatctcagaaacagttatttacacaaattgtgggagaggctctctatccgctttttttgttcacagattttatccctcagcccccatccccttcgctaacgctcagggacttcccccataaatgggggaagaattttctcataacaccgctctacaatacttcccctacttctccccaatacttcccccgcttgcgggggaaggtgcccgaagggcggatgggggcgaatatggggagtaattacattaatccgaaacaataaatatcatttttctttttattcgtcccacaaaacactcaaagtgggctttattgatatagagaatatctcttacccaaacaacctatccatctcttcaatcaactcctgacttggtttatcaaaataaacaccactatttggctcgccattcattcctcgtaggaataaataagccacgccgccaaagtgttgctcgtaattataattttcccctaagcgagcgcttaagtagcggtgaacggcaagggtatagagcaaatattgcaaatcatagcggaattgccccattgttttggctaatttttcggcttgataatcttgtggcaaatagcctaaaaaattggatttatagtcaatcacatagaatttgccgtcaatttgagcaatacaatcgacaaaaccacgcacaaagccttctaagttatataaggtcaaatcaggcaactgtttggctaacggactatgttttttcagtagttgattaagtcgatataaggcttctttattggataggcgtaaataaaattgccattcgttcaagcgtttatgggtaaaaatctgcgttaaactgaccgcttgttcaccaaatggggtttggataacttgctcaaaccacgttgttaaaggctcaagccacgcttcgtctaaattaagttgttcacacaatgcctgtaattgtgtttgatccaccgcttgttgaaaatcccaatgctcaaagaatttatgcaacagattaccgactttcgtgctatgtgggaattggtagcgactatatggctgagcgttatcttcaagaaagtccgaggcgatgaactctgtgcggtcataatcttgagcttcgtcaccaaaagtagcaagcggtatgttttgctctttatgttgcaaacgttcattttgagcctgtaatgccgtgaagctggtaatttgcccaacggtgcgaattttgcctgtaaaggatttcgcttcaatatcaataggttgcacgagtgttggttgccaattgtcttcaggcacatcattattaaccgtaatcagctccgctttaatgcctttctgtgctaaataatattgagtattttggcttggggcgatgccacctgttccaatctcaccattgcttaacaaatagcttagactattccatttttcatcaaattgacttggtaaaatcaggtttagctgatacttcgctcgtgtgaccgcaacatagagcaatcgcaaatcttccgcaaattctgccttatcaatatattttttgatttcgtcggattgtgagccgaaactccaataagccttgccttcatcattttgatagattgccattgatttacttttggctggttggcttgctttagccacaaacggcaaccaaaccacagggtattccaatccttttgaaccgtggatagtcactactttgactaaactttcttcgctctctaaacgctgtttttgttcatcggcgtagccatcgggattagctaattgctgttcataccaacgtagtaaggcgaactcgttctctaaatttggcattgccccttgtagtaattcggctaaatgcaacaggtcagtaatgcgacgttctgcattaggcaaagcattgatccgttggataatattttctttcacaaaaatttggtgcaacatcggtaaaatcccctgatgtagccaaacttgttgatagccgacaaagttttccaccacattatcccacgctttttcatcttgtttgatattaaaaatgtcggtcgatgttaagccccaaagcgatgtgccaatggctgaaagcaaactggattgacggtaagggtttaaacacgcagaaagaataaagcgtaaatcttgtgcttcttgggtttcatagacgctgtttcgttcagagaaaaagaccgatggaatatggcgttttaataattctgtacgaattaaactggcttgtttatggctacgcacaaggatcgtaatgtctttggcttcaagcggtctatttccctcctctttttgcacaaagagcaacccttgctcactctttttcagctgttgttgaatttgataagcacagtgagcggccgcaagctgttcatcaaactccgtgctgattaacagacatctggttgcttgttcacccactaatgcatccgaagcctttttagctttaactggttggaaaggaatgccgtgatataaaaatgggggattatttccttctgggaactgaaatagacgattacaactatccaccacttcaggcacagatcgccagttgcgatcaagggttgcttgttcctgaacctcattcttcgcggttaaataggtgaaaatatcagcgccacggaatttatagatcgattgctttggatcgccgatcataataaaaccttgctcgctggtattttgatccataaaaatacgacggaacacttcatattgctgttggttcgtatcttggaactcatcaatcatcgcaaatgggtacaaggctctaatttgttgagctaaatctgtaccacgttccgattgtaaagctgagagcaaaaagctcaacatatcgccaaaacttttctctttatgggtttgcttataatcggcaagtttttgacgtagatggctgaagaattgatagagcaaaatcgcttttgatttgccttcaaactgtgtttggtaagcggtgagataatcttgattttttgcaaaaatagcatgggtgagtggttctgccccctcctctgctttttcattgataaaatcctgacaaaagcgagagaagctattcgttgggaaataatgactaccgcttgtagcccattcgttcagctctttcaaccaattttcaacccaacgcatctgataagcacgacggctgagcgatttcttttcaccttttttgtagcttttgttgatttcagtgacaatcagactttccgcttctgctcctacagcaagccaatgttgcttagcttcttgtaacaaggcttgataatcggtgagatagcttgaaatgccttgtgtcagccattggttttctgccgttaaatctggaaaatcaccatagagataacctttcactgcggttaatgcgtcagaaggcgtttttaactcttcagcaacggcaacggtttccgcaagtcccattggataaaatagctcacgccaggtttcttcactcaaacggttaagcagttcgctctcattcgtcaataaatcaatatcaaaacgaatgccagagctaaacgcaaactgaaacagcatcttttgacagaagctatcaatggtaaaaatgctggctaaatcaatttcacgttcagcaatttttaagcgtaagagacattcatttaaacgaggttgaacttcttgataaagttctgccagaaaaggttcttgtaatgcttcttgcgcttctttagaagagggatctcgaaaccattttcctacattgaccaatttttcccgaatgcgatctcgtagctcttgtgtcgcggctttggtaaaggtgacaactaagatttgttcaaccgttaatggggagggacaccgaacccctaaaatcaaccgcaaatacaaatttgccatcgtataggttttgcctgtgccagcagaggcttcaataaggctagattggtttaaagctaattgtagcgaatttagtggattcatgattatcaaggcatgtagtgataaatgacatcattctacgctatttagttttaacgagaaatctttttagaacaatcgaaaagcgctcatattcgccccccttccgcccttcgggcaccttccccgtaaacgggggaagaattggaggggagggggaagtattgtagagcggcattatgagaaaattcttcccccatttatgggggaagtattgggaaagtgggggagcgaaatgatctgcaccccaaaagttggactaaacaaccaactaattaaggtgcagatttttatggctaaatacactcaatcttttaaacaacaagtgatcgaattttatcttcaaaataatagaattcggtcattaactcgtcagcattttcaggttaaggaaaccatattaagatattgaattaatcagtataatcacacctcgtgaaggaactacgccaccaatttccgtttgagattttattgcaattggttgatttaaaacggagtacgttcttttatcatcttgctgaaaaagacaataaaatggcaagttatcagtcgatattgaagcaaagtggcatcgtacaaagtatgtcgagaaagggaaattgtttggataacagtgcaatggaaagtttctttgggcgtttaaaaacggaatgttactttggtaaacggtttgagacctttgagcaactggaacaagctattcacgaatatattcattattacaatcatgagcgtattcaagtaagattgaaaggactaagccctgtggaatacagaactcagtccttgaactaaatcagtccaactttttgggagcagatcatagattagccccaaatattatgtgtgaaaatagcgaaaatacagtcatattttcaaccgcttgggaaaaaaatggtagaaattccatcacctattattcttgtaatgattattatagaaagatttatttttcggaatactgttgataattacgtaaaaacagtaccataagtaatgggaaagcaggagtgctaaataaataaccaaatttaactctaccacgctttcccttcaaaattctccagcaaaaaatcaattagttttctcacggcaagggggagtttatcccttgacggatacattgcataaatgctgaatgtcggcagttgccagtcggttaaaacggcttgcagtttgccctgttgaagttctggttctagcatatattttggtaacatcgcaatgccgttgctgtccagcacggagttgagcagggcttgggtgtcgttggtggtgaaacggctgtttaggtcgagcaacacttcctgttccccttgcgtacatttccacgctttgcggttgatgttatggtgcgacaaatagtgatgttgatacaaatcttcaggctgcgttggcgtaccgaactttgtcaaatattcaggcgttgccaccaacaatgaatggcaatcagcaagttttcgggcgataaaattcgggtcgggcgtgttggtaatccgaatggcaagatcgatccgctcgctgattaaatccatcgtctgatcgttaagcaacagctgaatattcaacttcgggtgtaactgcaaaaagcgattgaccatttgcactaaatgatacgccccgaaagtttggctactggtgacacgcaacgcaccacgcaattcaccctgctgtgccatcatttcttgttccatctctgcggttaagtttgcaattctttggcaaaaaagcaccgcttgttcgcctgcatctgttagggcgactttacgggtggaacgctgaaaaagtcgggcgttcagccattcttccattaaagcaacataacggctaatcatcggtttggaaatctctaaccgttctgcagtggcggtaaaactgcctgtttcggcaacggtcagaaagaccttgattgcggtgagtttgtccatagttatcctttttgtttcttaatcggaaataattatattctaaaatcgcactttttctctctttttatttcattaaaatgcacaccatcaatagcaatcaagctgaatgtataatccaacaaaaggaaaacaaaatgaaaaaattacttttacttttaactgcacttttctcatcaaccgttgcaatggcacaaactacgccagagcaaaataaagcgaatgcattggcgttctatgaaatggcgtttaaccaacatcaattacaagacgcagtggataaatatatcggcaaagagtatttgcaacacaacccaagtgtagccgatggtggtcaagcctttattgatgcttttgctccgtttttgaaagaacacccaacttcgcgagcaacagttaaacgtgtattagcggacggcgatttagtagcattacacgttcacagccagctcaatgaaaaagataaaggcgaagcggtggtggatattttccgtttcgatgaaaacggcaaaattgtagaacattgggacgtaatccaagcggtaccagaaaaaacagaaagcggacgtggaatgttttaatgaaaatttattatttattcgatcccctttgcggctggtgttatggtgcgtcagcaacattgcaaaaactcaatgaaatctatccgcttgcacttgtgccaacggggctgttttaccaaagcggtcgtaaaatggacgccgatttcgcccgctatgcgtgggataacgatcaacggttgcatattgtgccgagccagttgttgtatggggaagttcaagggttggaagattatttaaaacagttgtcatagaacttgtagaagagctgtgggattttcataagttttgtatttgcaaaatttcctgaaaaccccaccgctcttttatttttccgctaaatagctttcccgaaagccttttggcgtacatcgttcgtattttttgaagaatttattaaagtgagtagcttcttcaaaaccgagttgtaacgcaatgtgtttcacggatttttgggtatgcaccagtaggcgtttggcttcaagtagcaaacgttggttgataaccattttggcaggcagccccgtatgtgctaaacaggttgagccgagcgttttttttctgtgcaaccgagttgttccgcataaaattggacttgatgttgcgtgcaaaaatgttgttccaatagctgagaaaaaccttgccaacgttgattttggtggtcttcttgtggctgatttgcagcataaagggtgttgagcaaggtcagaaaggtgtgtaactgcgtttgtaataagggctgataattttgcccttgccattcaaagtagcgatattgtttgagctgttgtaacgccagttgcagcaaaggggcttgctcggcggttacagattgcttttgtggcagctgttgccaaattgaggctaaatcagcagaaacccattcggctggaaaagataatccccaaccgtcccaaccttccattgtttgaaaatggtgaacttgctgtgggcggatcagcaaccattcgcctgtgcgttgcgtaacgctttggaaatcaagcaaatgctgacattccccttctgttacccacagccaaacataaaaatcaaagcgatgttgctcagcgagcatttcccgtgttaattcatcagcgtgcaaattgctttggttaaattcactaaatagacaaatttcaagtgccgattgcggtgtggggattgcttgtgtatttcctatttttgccattattaagcccttttttacctttttcatactggtattttacggaataatacacttcatcgaaagcaaagacaatgaaggataaaaaatgaaacaaacagcattgattacaggtgcatcaaatggtatcggtttggaactagcaaaaattcacgccaaaaaaggcggcgatgtggtgttggtggcacgttcaaaagagaaattggccgaactagcacacgacttagctaacacatacggtattaaagccaccgttatcgcccaagatttatcagaacctaatgcggcacaagcgatttttgcacagacggaagcacagggcattaccgttgatattctaatcaataatgcaggttttggcggacacggtcgcttttttgagcgtgatttagccaaagaacaacaaatgatccaagtaaacatcaccactttaaccgagttaagccatttttacttaaaaggtatggtggaacgccgctgtggtaaaattctaaacgtttcttcaacggcaggctttttacctggtccattacaagcggtttattatgcaacaaaagcctatgtcacgtctttcagccaagccattgccgaagaagtggcagaatttggcgtaactgtaaccgcactttgtccaggggctgtgacaacaggttttgtaaaaaatcttcattttatttccttttatttcagttggttaataagttcggtgtacgtcttagcctattttgcaaagcgatagcaacaccattgttaaaaaagcgagtagcgacaagctgtaaaacgcgaacccttttggggtgcgaatgtttttttgtgccacaacaccgaaaacgatatagaccacgacaagtaacaactttatcgctaaccaagtttctgtaaatggcgaccaagagccgagtatttgcattgtggtaaatggcgagcgtgaagcgcggttgggagagcaatatttttggggctgacatagattagctagtatgctaacctacaaaaatgaagataactcattgtaaattaaagaaatctatacaaaaaaatctccttgaattttttgtattagaagtcactgtccgttctgcggcaaatttattagagataaatgctaactctgctgcactgttttaccgcaaaatccgcgaggttatcagttatcatttagcacttgaagcagatgaagtatctgacggacaaattgagctggatgaaagctattttggtggacatcgtaaaggaaaacgaggtcgtgggcggtggaaaagtggctgttttggggatattgaaacggcaaggaaaagtatttactgtggtagtcaatgatacgcagacaacaacgccaatgcctgttatagcaaggaaaatcaagcctgatagctgggtttatacagatacttaccatagttatgatgcccttgatgtaagtgaatttcaccacgaacgaattagccattcggagctgtttacagtgaaacaaaatcacatcaacggcattgaaaatttttggagtcaagccaagcggatactccgaaaatataatgtaattgaccgaaaaagtttccctttattcttgaaagaatatgaatttcggtttaactttgggataccaaaagagcaacttaaaacgttgagaaaatggtgtaaaaattagagctaatctacgtcagccccaaaagtaatatcaaactttataaatgtaatatttatcctactctaataaagattgggaatgactatctaatagcgttcaaaaaaactctattgatgattacattcttgatatgtaaaacactaaatcgttttttaacatttatttaggcaaatgaagaaaaattatttcatcacgcaaaaacaataagatacataacactatatttataaaggattctttaaataaaaatatagttgctaagaataattaaagtattcatcagcaactattttattttctgaacctaacttttaaggctaagcgtaatacatctcaaattccacaggatgtggggtcatattcaaacgctcaacttctttacgtttcattgcaataaaggcatcgataaactctttagtgaacacaccgccttgggttaaaaattcataatctttttccaagttatctaacgcttcacctaatgaacttgacactgctgggatctcttttaactcctctggtggtaagtcatagaggtttttatccattgcatcgcctgggtggattttgttaatcacaccatcaagaccagccattaacaacgccgcaaaacataagtatgggtttgccattggatctgggaaacgtgcttcaacacgggttgctttcgggctagttactgcaggaatacggatagatgcagagcggttacttgcagaataagctaataatacaggcgcttcaaagcctggtactaaacgtttgtatgagtttgttgttgggttagtgaacgcatttaaggctttagcgtgtttgatgatgcctccgatatagtaaagggcagtttcagacaaacctgcatatttatcgcccataaagacgtttttaccatctttgcttaacgacatattacagtgcatacctgagccgttatcacctgcaaatggttttggcataaagcaagcggttttaccgtgttcaagggcaacgttttgaaccacatatttataaatttgggtttcatctgcttttaaagttaaactattgaaacggcttgcaatttcattttgacctgctgtcgccacttcgtgatgatgagcttcaatcactaagcccatttcttctaaaatcaaacacatctcagaacgaatatcgtgagccgtgtcgattggcgctactgcacagtaaccgccttttttgagtggacgatacgcattattgccatcttcatatttacggttagtattccacgccgcttcaatatcatcaatatgataagacacattgttcatctctgtgctaaaacgaacatcatcaaaaaggaagaactcaggctctggaccaaacattacgctatcagcaatgcctgttgattttaggtagttttcagcacgaatagcaattgaacgtgggtcacggtcatagctttgcattgtgtttgggtcgaagatgctacagcggatagtgagggttgggatacgggcgaaagggtctacaacggcggtttcaggaattggcattaacagcatatcggctttgttaatcgctcgccaaccttcaaccgaggatccgtcaaacattcgcccctcttcaaaaaggtcttcgaggtcgtctgcgacaagggaaacaggcattgacaccccgtgttctttacctttaatgtcggtaaatttcagtaagacaaatttaatatcattctctcgaatgagttttgcaacgtttgcaatggcgttggtgtttgacatttgctaatcctcttaaaataataactacaaataaaaaagtgtctgagacgctgtttaaaataccataagaaaaagaaatatcaataaaaatttttatgaccttcattattttttctaatatctttgtttgcaaaacaactttgttctctatcgacactatattgtgattaaaaatgctcgtcaatgtatttcaatagagagataaaattaacgctatacctaacaaatcgcagccgctcgactcgttaagtacaaatatcaaaccgcattgtcattcacaaactgccagttaagaaaaactccaacatagtagtttaagttacattgaaaataataagagcgcctcaatctcctcgcgtctaggaattgctgtctgtgcccccattcttgtgaccgaaattgccgctgctgcgtgagcaaaacgaatagattctttaggtgattttccttctaataatgccgtcacaaaagctccgttaaatgtatcgcctgcggctgttgtatccactgcatcgacacggaaccctggaataatttcaccttgtcctttttcgctataaaacaaaccttttgagcctagggtaattaagaccgtttcgatcccaagttgatgaaaatagttggcagctacagctgcagtttgctcattggtcactttaattccagtcagtatttccgcttctgtttcatttggggttataatgtcaatttgtgataatacactgtccggtaaaggttgagcgggagcgggatttaacaccacttttacccctgcttttttggcaatttttgcagccttagccaccgcttgtaacggactttccaactgcattagcaaaatatccgcttgttcaatatgtgatttatgttgttcaactaaggcttctgaaagatccgcatttgcgccagcggaaatcacaatgctattttcacccgaatcggcaacctgaatcatcgctaaccctgttgattggttttcaagaacagaaattgcttctgtattgatcccgtcttgttcaaaggcttgcttcattgttttcccaatttgatcatctccaattacaccaataaagtgaacatttgcaccacatcttgccgctgcaaccgcttgatttgccccttttccaccataagcaatttgataaccgtaacctgttaaggtttcgcctgcttttggaaaataaggcacacgaataacgtgatcaacgttgatactaccgagaatacagagttttttcataactactcctaaatatagaggcgaaacatctttcgcctccaatatgaaaagagggcaaatatcatttgctcctacagataaactatttagaaatgacttttaatggaaccggaatttgtgcttcaactttttcacctttcaacactttatccgctacttcaacacctaactcaccaattttttctggttgttgtgcaattgttgctgcaagttgtccaccattcaccgcttttactgcatcgtctgtaccgtcaaaaccaaccactaaaatgtttttgcctgatgctttgattgcacgtaaagcccctaatgccatctcatcattttgagcaaataccgctttagcagaaccgtggctggcaagtaagttttccatcacgtttaaacctttagtgcggtcaaaatctgctggttggctagcaagcagttcaaattggttagcttctaccgcttgtttaaaaccttctccacgctcacgcgcagcagaggtgccagcaataccttctaattgaattacttttgcatttttaccgactttttcagcgataaaatcccccgccatttttccacctgctacgttatcggaggcaatatggcttactacattgcctttatttgcaccacggtctaaggtgatgactggaatattcttcttattggctacagcaacggctgtacctaccgcttcagaatcggttgggttaattaataatacttttgcaccacgtaccgtcacatcttcgacattagacaactctttcgctgggtcattttgtgaatccaaaacaactaagttatagcctaattctttggcttttttctctgcaccttctttcaaggtcacaaagaatggattatctaaggttgaaattgccagagcgatagtttcttttgccattgctgatgtactgaatgctaaacctaatgcaatcgctaatgaagttaattttttcataaaaatctcctatgtgatgaagaataatctcttagagcagctacacttttttacgacctatgaagttatctaagataactgcagctaaaattaccagcgctttcgcaactagttgatagtaagagtcaatgtctaataaattcaaggcattgctcaagaaaccgataattaatgcaccgattaatgtgccgataatacgacctttaccgcccataagactggtaccacccactacaacagccgctatcgcatctaattcatagcctgttcctgcggttggttgggcagagcctaaacgagaggtgatgatcaaaccagcaagggcagccaatacaccgctgacagcaaacacaaagagtttaactttatttacattaatacctgaaagtgcggttgccgattcgtttccccctaaggcataaatataacgccccatacgagtctgggtcagaacaaaccaacctaatgcaaataaggcaaacatcagccaaacaggaactggaataccgagccaaatccctgtgccgatttcggcgaaagcatcagcattatcggaaaaacctgtgctaatcgggcgaccgcccatataaatcatcgttacaccacgcaataacagcatcgtaatcaaagttgccataaaggcttgaactttaccaaatgccaccagcgatccattaagtaaaccgattaaaccaccaaaaaccagtacggtgggaatcacgacataaacgggtaaatctattccaactaatgttgcagccacagctcccgtcagagcaagtactgaaccaacagataaatcaataccagcaatcaaaatcacaaaggtcataccaatcgcaataatggcgttcacagaggtttgacgcagaatgttgagcaaattatctgtggtaaaaaaatccggatttaaaaatgacaccacaacaatcagggtgattaacgcaataatcgaccgctgttcaattaaaaattttgttaagttaaacgatttattcatttgcaaatttcctatgagatctggccgcttgttttaccaattgctgctgctaataatttttcttgagtcgcttcttgacggctaaattcaccgctgattcgaccttctcgcatcactaaaatacggtcggacattcctaaaacttctggcatatcggacgatactaaaataatactaagcccttccgctttaaatttattgataagttgatagatttctttttttgctccaacatctacgcctcttgttggttcatctaaaatcagcacattcggacgagtcattaagcctttggcaatcgccactttttgctgatttcctccagataactcaccaataattttatcggcattgggggttttaatattaaacagttcaataaaatccgtgacgaccatattctcacgcactttatcaattcgtccgtagtgggaaaggtgagctaatgcggtcaaagacatattctccttcaccgacatacctagcactaaaccatcacccttacgatcttcggaaatatagacaatgccgttatctaatccttcttgagcggtatggttatgaatgtctttgccatctaatctgactgaacccgatgtacgaggcaatgccccgtaaagtactttcatcaactcagttcgcccagcccccatcaatcctgaaacaccgataatttcgccttttctcaggttgaatgagatttgataaacgccgcctcccgtcaaattattgatctcaaggcatacactaccttgatcggtgtcgatatgcggatattgttcttccaattttcgtccgaccatcatttcaatcaactgatcttcagttaaatcggtaaccgctttttctccaatgaattgaccatcacgcaaaacagtcacatcatcacaaatttggaaaatctctttaatgcggtgggaaatatagacaataccatgaccttccgctttcaactcacgaatcaccgcaaataaagcttctgtttccgtatccgtcagcgcatccgttggttcatccatcacaatcactttcgattcaaaactcaacgctttagcaatctctaccatttgtcgttcaccgatagaaagctcaccagcaggaagtttactggaatgacgaacaccaaggcgggctaacaagcggtcggattctgcatacattttacgccaatcaataccaccccaagggtgcgtaaattcacgtcctaaaaagatgttttcagcaatggagagattaccgagtatatttagctcttggtgaataatactcaacccagcttcttgagaggctttcggattagcaaatttcactgcttgccccagatattcaatcgtaccggcatcacgttgataaattccggtgagaattttcattaaggtggatttacccgcaccattttcccccattaaagccatcgctctacccgcatagacattcaagcaagcatttttaagagcctgaacaccgggaaaggctttatcaattccgctaattttgagtaaggtcttcatcatatccacctaaaatggtacgcccgaataaagaataacattcgcatacgggctacattctcccgttctaacgacggctttggcttgattactttgatgtttaaattcgttatgtgggatatattcaatcttaatggtatttttttgttgcacctctatttgttgaataaccattaataactgttgttcaatttgaggattaatattcttgatttcttcagctaatacaattttttcaataaataattcacttgataccgcttgtaagactgaaagaaaatcggggatacctttggttaaagcaaggtcaatgcaatgctgctctgttggaattggtaaaccagcatcacaaattgtgagtccatcggtatgtcccattgttgcaattacatgtgaaagttgagcatttaagattgttgtctttttcatcacaaaccatccttacaaatccatcgaaacgtttcgatgactaaaagatagacaaaaaataataaaaaaacaactatgttattttgaaaatgtgaactacttcaaaaaataggtttaaaaagattcccgtatgattaattcaggggttagcttgatcgtttctatttccgtttgtggttgctgaatacgtagaattaatttctcaacagcagctttagctaatcgggctttaggttgatgaatagtagaaagagggggataaagatattgagcaagttcgatattatcgtaaccgataatcgcaatatcttgcggaatccgtaatcctgctcgttgaatcatttgatatgcaccaatcgcaatgctgtcactcatagcaaaaaccgcacgcgggcgattttccagcaccaacagtttagtcatcgcctcgacaccaccgtcataatggaaatggctttcaataatccattcggggcgaatttgcaaattattctctaaaagtacccgcttgtagccagctaaacggttttgagccaacggttttgaaagttcaccggtaataatggctatatcatgataaccagcatcaattaatgcttttgtcgcaagataaccgcctagttctgaattttcgtgaatgatatcggcatttaaaggttgttgccaccagtcaatcacaaccatcgggagtgttaaatgggtaatcgcacttaagtcaaaattttgaggttctgcacacatcagcaataagccatcaacttgctttaataacaacctctctagatgttgctgtaaattttggctgttgccgtcggtattaactagaatcaggtgataatgatggcgttcacaataacgttccacatgacgaactacttctgcaaaaaagggattattgctagtcgtcacaatcataccaatggtattggtttccttgatcttcaaacttcttgctaccaaagaagggcgataatttagctcctcaataacttttttgacttttaaagtaatttcttcactgacaaaacgggaattgtttacgacgtgagaaacggtcgaaagtgaaacccctgcaattcgagctatatctttcattgttgccatagtgagcctttataaattgctgagaaataaaaacgccctaatataaacatattaaggcgtttctgtatataaaattaacgtctattcgctaatttcgttttagtgagttcgtaaacatgcagtttagcaatttcgcgagctaatttggcggtcatatccgcttcatttgttttgcttattgtttcttctgctttgcgttttgctgcaaggatacgttgttcatcgagttcttcaccacgaattgcaacgtctgcaagcacggtcacaaccgttggttgaacttcaaggaatccgcctgaaacatagatatattcttctttgttatcttccaaagtgaatttgaccatgccaggtttaatggcggttaatagtggggtgtgtcctgcatagacacctaattccccatctacccctgaaactcgaacactagttacttgaccttcaaagattttacgctctgcactaacgactgtgagttcaaatgatgtcattttgttctccttagttcaaagaacaattacatcttgttggctctttcaaccacttcgtcaattgaacctgccatatagaacgcttgttctgggatatggtcgtattcgcctgctaaaatgcctttgaaaccacgaattgtttcttttaatggtacaaatttacctggtacgctgttgaacacttctgcaacgtggaatggttgtgataagaaacgttcaattttacgcgcacgagcaacaacaagtttgtcgtcttcagataattcgtccataccaagaattgcaataatgtctttcaactctttgtaacgttgaagcgttttttgtacgccacgtgcaacatcatagtgctcttgaccaacaacgagtgggtctaattgacgtgatgttgaatcaagcgggtcgatcgcagggtaaatacctaatgatgcgatgttacggcttaatacaaccgttgagtctaagtgagcaaaggttgttgctggtgatgggtctgttaagtcatcagcaggaacgtaaaccgcttgaaccgaggtgatagaacctgttttggttgacgtaatacgttcttgtagaacacccatttcttccgcaagtgttggttggtaacctaccgctgatggcatacgacctaataacgctgatacttctgtacctgcaagggtataacgatagatgttatcgacgaagaataacacgtcacgaccttcatcacggaatttttccgccatggttaaaccagttaacgcaacacgtaaacggttacctggtggctcgttcatctgaccataaaccaatgatactttatctaatacgttagagtctttcatctcgtggtagaagtcattaccttcacgagtacgctcaccaacacctgcgaatactgagtaaccagagtgttcgattgcgatgttacggattaactccatcatatttaccgttttacctacgccagcaccaccgaataaaccaactttaccccctttagcaaacggagcgatcaagtcgataactttgatccctgtttctaaaagttctgtgctgtttgcttgctcttcatagcttggtgctgcacggtgaatcgtccaacgctcttcttcaccgataggacctgcttcatcaataggctcacctaatacgttcataatacgaccaagcgtttttgtacccactggtacttcaatcgctttattcgtattttcaacttttaagccacgttttaaaccatcagatgtaccaagagcgatacagcgtactacaccaccgcctaattgttgttgaacttcaagggttaaacctgtttcaacttttaatgcatcataaacttttggtactgcatcttgtggaaactcaacatcgattaccgcaccgatgatttgtacaatttttcccgttgccattaccgttcctctattcattgttaaattgctgcggcacccgcgacaatttcatttaattcattcgtaatacttgcttgacgagctttgttatacaccaactgtaactcattgattaaattacctgcgttatccgttgctgctttcattgctaccattcgagctgcctgttcagatgcaagattatctacgatcgcttgataaacttgagattctaaatagcgaacaagtaagctatctagcaacacttttggattaggctcatagatataatcccacgaacctttattttccaaatcgtcatcttcaagttctggcaatggaagtaatttttgaaccgttggtttttgcgacatcgtattcacgaagcggttataaataatatagacttcatcaacttcgccattacggtagttttcaatcataccatttacaataccaactaaatcttccattgcaggtgtatcacctaagcccgttacttgagctttgatttccacccccattgattggaaaaatgaaactgctttgtttccaaccaatcctaagactgaatccacccctttatctttacgtgtttttaactcatttaaaacggttttaaataaattaatgtttaagccaccgcatagaccacggtccgttgaaacaacaataaatccaacttttttgacttcacgttcggttaagaaaggatgtttataatcaatacttcctttggcaatatggctaattaccttacgaatggcatctgagtatggacgtgatgcagacattctttcttgcgttttacgcattttagatgcagcaaccatctccatcgctttggtaattttttgtgtattacgaacacttgcaattttggttcttatctctttagcacctgccatattctttctccgctaaagtagattaccaagcactattctttttgaaactatctaaaatctcgattaatttcgctttgatagtgtcattgaaatcgcctgatttacttaaatctttcataaactcagcataatttgcatttgcataagctaaaagatttgattcaaatgaacctacacgctcaacttcaacatcatctaaataaccaaattcagctgctgcaagtgataaacctaattgtgccacagacattggttcgaattgtttctgtttaagtaactctgttactttttgaccgtgtgaaagttgcttacgtgttgcatcatcaagatctgaagcaaactgagcaaaggctgctaattcacggtactgagcaagtgcagtacggataccacccgctaatttcttaacaagtttagtttgtgcagaaccaccaacacgagataccgaaatacctgggttcaccgctggacgaatacctgcgttaaagaagctggtttctaagaagatctgaccatcggtaatcgaaattacgtttgttggaacgaatgctgaaacgtcacctgcttgggtttcaataattggtaatgcagttaaagaacctgtttgaccttttactgcaccattggtgaaacgttctacataatctgcatttacacgagcagcacgctcaagtaaacgagagtgtaggtagaatacatcacctggataggcttcacgacctggtggacgacgtaataacaatgaaatttgacggtaagcaactgcttgcttagataaatcatcgtaaacgattaacgcatcttcaccacgatcacggaagtattcacccattgcacaacctgcataaggtgctaaatattgtaatgctgcagattctgatgcacttgctactaccacgatagtattttgtaacgcaccgtgttcttctaatttacgtactacgttagaaatggtagacgctttttgaccgatagccacatagatacatttaatacctgaatcacgttggttaatgatcgcatcaatcgctaatgctgttttacctgtttgacggtcaccgatgattaactcacgctgaccacgaccgattggcaccattgagtcaacggctttatagccagtctgaactggttgatcaacagattggcggtcgataacgcctggtgcaatcacttcgattggcgagaaaccgtcattatcgatttcacctttaccatcgattggctgacctaatgtgtttactacacgacctaataaaccacgaccaacagggacttctaaaatacggccagtacatttcacttccataccctctgctaaatctgcgtatggacccattactactgcaccaactgaatctctttctaagtttaaagcaatcgcataacgattgcctggtaatgcaatcatctcaccttgcattacatcagcgagaccgtggatacgaataaccccgtcgctgactgaaacgattgtaccagtactttgtgcttcactaaccacattgaactgtgcaatacgttttttaatcaattcactaatttctgtagaatttagttgcattttctattcctcttacaagcacaactcttggctcaaacgatttaactgaccacgactactaccatcaatgacaacatcatcgtaacgaataataacgcctgcaattaatgacgcatcgatacttgtcgtaattcgaacttcactatttagcttttgtttcatcgctttagcgattttatcttcctgtgcttttgttaaaggtgttgctgatgtaacacacacatctttaacggattcatactccgcacggatttgattaaaactagcaaatactgaaggtaacgccgaaagacgcttattctcagccatgactcgaatgaaattttgcccatattgatcgagttgatcaccacaaattgcgataaaggtatcggcaacttgagtggctgcagaagatgaatgaataaaatgttgcacatcttcattttcagcaaccaatgcagaaaactgtaacatttcctgccatttatctaactgaccttgttctaaagcaaaatcaaaagctgctttagcataggggcgagctactgttgttaattgtgacatctgccccccttaattataattctgcaactagcttatcaatgatgtcattgtttgccgctgcatcaacagaacgacccacaattttctctgcaccagcaaccgccaatgcagccactttttgacgaagttcttcttgaacacgacgacgctcgttttccacttctgcgtaaccttgctcaataattttcgctttctctgcttcagcttctgcttgaacagattctaaaatttcattgcgacgttttgttgctaaatcaatgatatgttgcgcttcttcacgagctttagcgagttcttgctcaactaaaactttagtatcagcttgttcttgcttcgctttctcagcacttgcaagagcgtctgcaatatttgcttgacgcgtttcaatcgctttaataagcggtggccatacaaacttcatacagaaccacacaaatagtgcgaatgcaatcagttggcctattagtgttgcatttaagttcacaacgccctccttaagtcggctaagttactcttgagtaactacggttaaaaacaaatccgacttatttcaataaatcaatgaacgggtttgcgaagatgaaaagtaaagaaatacctactgcaatcattgcaatcgcatctaaaagacctgcaacgataaacattttagtttgtaagctgcttgctaattctggttgacgagctgaagactctaagaatttaccacctaagatagcgaagccaattgcagtacctaatgctgcgaaagcaagtaggattgatgcgccaataatagttgctgtaattacagtttccataatgttctccataaaagtaaggaaattagccttatggctagggttaataaaaaagtttcaataaatatgatcgggtttcataagcggtctaatcattgcaattttttgcataaaagtaaccgctcaccaatccagtttgtttagtgatccgctttattataagcaatactcaagtaaacaatcgttagcatcataaagataaaggcttgtaacgtaataaccaaaatatggaaaatcgcccaagctaagtgtaatggcaaacctaatgcttgaagcaagaagttatccgccatatacatcactgcaatcaggataaaaattaactcacctgcatacatattaccgaataaacggaatgcaagagaaatcggtttcgccaataacgttacgatctcaagtacaaagtttacaggaataaatgcccagtggttaaatgggtgaagcgtatattctttaacaaaaccagaaaaacctttcgatttaatggtgtaaaaaataattaaacagaatacacagatcgccatacctaaggttgcactaatgtctgctgttggaacagcacgcaaatagtcaatccctaataatgcagcaaattgtggtggataatccacaggaattaagtcgatagcattcattacgaacacccagcagaacacagttaaagctaaaggagcaacaacctcacgactaccgtggaagttatctttaaccaaaccatcaacccactcgacaatcatttcaacaaaacattgaaatttacctggtacgccatctgttgcattcttcgccacacgagagaagaaaaagaggaaagttgcacctgctactaatgagaaaaacagagtatctaaatgcacattccaaaaaccgtcccctgtttttaagaacgataagtggtgaccaatatagtcagccgttgtttgaccagccatagcttatccctttgaaattaaaagaaatttattttgaatgccatttcaatgcaataggcaaaagactattacaaagaataataaaaaagaacccacaaaaaaacgaaacatagtgcatagcaccataacttttaaatgccactacaatcacaacaatcgtcgtaagccatttcagcccttccccacgataaaaagcggtcatattttggggatttattaccgactgacgaaaaaacacccaatacacaaacacacaatgcggaagcaacgccgcaatttcccctaataataacgaaataaagcgatttaagcccaacccaatccccactgctcctgctatgcagaacagcagaattaactcgataccgagtgctttttgataaagttgtttcgtttgtcgaagaaccgcagacatttttaactaaaacctaataaaaaagtaaacgatttctttgtgtaaactaatctaaagttacgcaatcaaaatcttccgaattatacgcagattgaccaaaattgccaacctgtaaaccctgcaaaaatttcggttacttaacatttttataaaaaaattaacattcttatgcttttagaaataaatatccctgatattatttgcgacataatgtattttcatatgctattaagaaaaagttaataattttgttggtaaaagcccaaagggctcttgtgaacacttcaatataaccaattaaattctagcgagagcacctaatagagatatgccaaattttttagcggaatttgagaaaactccctgttaattttctgaaaatcggtataatcaaactgttgttcaacttccttgataatgcttatgcaaccgatactttattccctccctgattttctcttatcgccactgttttgggtgtttgccttattggtatttgcaatttggcagttcattcgcaataaattacgaatggatattgttgccttactcgttattgccttttttagtctaagtggcattctttcggtcaatgaagtgtttgctggattaagtgatccgaatgtgattttgattgctttgctctttattgtgggcgaggggcttgtaagaacagggattgcctatcaggtgagtgagtggctaatgcgtgttgcaggggcaagcgaagttaaggttttagtgttgttgatgttatctattgctggacttggctcttttatgagttcaacggggattgtggctatttttattcctgtggtgttggcaatttgttcgggtatggggatttctccgaaacgcttaatgatgccgctgagttttgctgggcttattagcggtatgatgaccttaattgcgacaccgcccaatcttgtggctaactctgaattagttaaagcaggacatcaaggttttggtttcttcagttttacaccgattggcgtttcggtcttggtgctggggattgtttatatgctttttgctcgccgttggttagataatggcgaaacagtccgcactgaaaataaaaatggttcatcaatgcaacagcttattgcggaatataatttaactgggcgggcaaaaatggtggtgatcgatgctggttcatcattgattggaaaaacgatcaatgaattaaatctccgccgcgagtatgggctaaatatcgttgctattcaacgtgttaaacgtttaagaacgctttctattgccgcctatggtacggaaactttgcaaggaaaagatattctgttgatggatattaatattgatttagaccgctttttgcaacggtgtgaggactttggtttacgcataattgagttgaaaggggactatttctcagaacacgcaaaatctgttggaatggcggaattttcgattatgcctgaagcaggaagtatcggaaaaagtattagtgaacttaaattgcgttctacctatggcttaagtgtcgtcgggttaaaacgtggggatacattgattgaagataatctgatttcaaccccgttagaatttggtgataccttgctgattatgggggtatggaataatttgctcaaactcgatcacaataaccgtgacttcttcctactcaaagctcccgaagagagcaaacacgcagcaccagcgattagccaagcacctcacgcaattttttcgattgtcacaatggtggtgttgatgattacagggttagtgccgaatgtgattgcggctttgattgcctgtttgatgttgggcaaattccgttgtgttgatatgaaaagtgcttacgaatcaatccattggccgagtattgttttaattgtcggtatgatgccattttccattgcattacaaaaaacaggcgggatcgatctgattgttcaaatgctcactgagattatgcaaggcttaggggtgcattttgtgttgatggtgttatttatttttaccgccatcatcaatgcctttatctcaaatacagccactgcaattttagtaatgccgattgccattgctatcgcacaacagctaaatttttcgccagtaccatttgcaatgattgtcgctatttcagcctcagcctcttttattacccccgtttcatctcctgtgaatacgatggtacttgcaccaagtggctatagttttatggattttgtgaaagtaggattaccgtttacgcttttggtaatgctgttagcagtatttttggtgccgatgttgtttccgctttgattattttatattcattgtttgatcttccaatgattcacgccccccaagagagcctctcccacaatttgtgtaaatacctgtttctgagataatacattcagacacaggtattttattatgaacgaaaaacaacttcacgccttggcagcggaatttgccaaaaatctaaaaacactggaagacctcaatcaattttcacggatgctcaagaaaatcaccgtcgaggctgcgttaaatggtgaactgaccgaccatcttggttatctaaaacgaaaattcagctttgcattgtgcatttagtgcgtaacagcttgaaattcgtttcgtggaaagattacaaagccgtcaccgcagatttaaagcaggtttatcaagccccgacggatgattcagttttcaaagtgatttggcttgcgattaaagatacatcaaaaaaatggacaatgccgattcagaactggaaactggcaatgaatcgatttatgattgattttggtgatcgcctagacgatcaccgttaagttgaaatgggtgtttacacagaatttgggatagggtctagttaccaagtataactgatatctacacctaaatttacattagaatattgactaccatatttttgcaattctaatgttgaacctactttcaatccatttgaaaaagctttattaatactagttgccaatccataaattgtattatgtgaactaattttatacacattactcttatcattagattgagatagtttcagactgtcattgatgaatgcaatatttggccggatatttacattaatatcatttatcttatacataagattcacaccaacatctccagcataaactgttctcttattaacagcgacatcctgatctaacaatgttctattggaacgagaaatataggcaccaaacgaaggactcacactcagatcttcactcaatctaagttgataagcatagttcaaataaagatcaacattgttattacgttcataaagtcttggtgttttacgccacggtaacgaataaaaccagcaatctgatgattatccagttgatattttgctctcataccaacatgataacttttttgatgtttattgctatattcaaaaaacaatccagcctgaactttttcactaaccgtcttatttccacctaaagagagcttattatattttgaacccccactataatgagcaaaaacatcatcaaaagagcgatacaaaatatcatggttgtattcatttaaatgcttagcctgctcaatatatttggtaaagtccaatggattcttcaaagctaaaaacatggtatacaagctatcatataaatcatgaacacctaaataattgacatttgttgtattcttagattctgaaatagtattaatagatgctaatgcatcttggaaattcttaagattggatggtaaagccttttcaaaagaaaccgcttgttgacttaatgcaaagcttttgagttttaattctgacatagcttgatcaagagcgttagactgtgctattgcgttatcatttgccctacgaagtttagcaatcaattcgtctttttgcccctgattcaaatgcattaaagcattaattttttcaacatcaggttcaatttcatcaggaagattccattcaagggctttagcttgaatatctgtcatatattgtgtcaaattttttacagtaatatttccatcatcctcataagcaacaaataaatttccctctttataagccaaagatgaataacctgcacccgctgcatttccagaaccaggtctgataatagccacctcatatacatgttgtggatcttttgcatctagcatataaagagcaaggttacccctagcccagttatcattattaccattaggttttgaaacgagcaatactctcctaccgtttggcaaggtaacataaattgatgagccttgacttggttgggctgtactagaaccaaaactcgcaggttcataagcatgccaactcttacccatatcttctgtatagtatgcccatcgtttatctgcttgagttcctcttactctctcctcccttccaaccataattaatttattccccatctcaaaaaccatattctctaaagagctttgattcggtgctggaagatccgttgtttctggcatttcccaagtttttccattatctttagaatacataatggttgctgcaataccataattatgagcagtttgtattggaaatactaatgttccattacgcatcacaataccagaaccaacacctcctaaaaaactaactactgggttatttggacctttacttactttagaaaaacatcggggttacttaatttactaaattcagcatttttctcccaagttttccctccatctatagacttataaatggttgtagcccaaatattattttgaaaatagttgaaacgatcttgataccaaaatccattacctgtagcccaagtcccatgcatagcatagatactaccatctatactgttatacaaaatcgtaggatccatagctcttcgcaaaggcattttagaatcattaaatgtccaagctgttttacttaaccaagtatttcctccatcttctgaaatggatacacctggatcgattctatcttgatcggatgcgctgttccatcttaaatcatacataacaaccattttattatcatctgtaatggtcattgctggaatacggctataatatagaggcactgtaccaggagcctctccattaggacctataccaggccataatcgtccttcttcacctaccgtaaaattatcctgacctactcgtttagttatatgagttagattctcgtttaaatcgcttttccagaacgtagtagcatgcaaattagatgctaatgctagaaaaatcaatgaaggtacaaaactgcatttaacatttttagataatcttcttttcattttttctcctttgctttaaataattaaaatttacggatacagcaaaaaaacaacatagcaatatataaaaattagatataccccctccatattttcacaaacgtattaaactactaaatacactaaaaatctgtgatatagttaacatttttgaaataattctctatattaatataaaaatatgtagctttgctacaagtttactttattaaggaaaacacataaatgtaaagaaaagatacatttagcaatcgtgaaaaaaacaaaaacccccagcatttctgctaggggttttaatttttattgttgattaagctactgctttttcaacaacacgaactaaagtgtgagatttagttttagagagtgggcgacactctttaacttcaactacatcgcctaatttagcttcgttgttttcatcgtgtacgtgtaattttgttgtacgacggataaacttaccataaattgggtgtttaactgtgcgttcgatagcaactacaaatgatttgtccattttgtcgctaacaactttaccttgtactgtacgaattttatcagtcattactcacccgccttttcggttaatacagttttaacttgtgcaatgctacgacgcacttgttttaactggtgggtttgttgaagctgaccggtggctgcttgcatacgcaatttgaactgttcacctaaaaggttcactaattcaccattcagctcttcaacacttttgttacgtagttcttgagctttcattacatcaccgtcttagttacaaatgtggttttgaacggaagtttagctgctgctaatgcgaatgcattgcgtgcaacttcttcagatacaccatccatttcatagagaactttacccggctggattaaggctacccagtactctacgttacctttacctttacccatacggacttctaatggtttttcagtaattggtttgtctgggaacacacggatccagattttaccttgacgttttactgcacggctcatcgcacgacgcgctgcttcgatttgacgagctgttaaacgaccacgaccaattgcttttaagccgaatgaaccgaagctcacttctgtaccgcccgcgataccacggttacggcctttgtgtactttacggaattttgtacgttttggttgtaacattcagtgatctccttatttacgacctttgcgagctggctttttaggctgtgccgctggttctttctcagattcaatcactgcagccattccaccaagaatttcacctttgaagatccacactttaacgccgattacgccgtaagttgtgtgagcttcagctgtgttatagtcgatgtcagcacgaagagtatgtagaggcacacgaccttcacgataccattctgaacgtgcgatttctgcaccacctaaacgaccgcttacttcaactttgatacctttagcacctaaacgcattgcgttttgtaccgcacgtttcattgcacgacggaacattacacgacgctcaagttgagcagcaatgctatctgcaactaattttgcatctagctctggttttttcacttcagaaatgttgatttgtgcaggaacgccagcaattttagatactgcgtttcttaatttttcaacatcttcgccttttttaccgataacgatacctgggcgagctgtgtgaatagttacacgaatgctttttgctggacgctcgatagtaatacgagatacagacgcgttcgctaactctttgtttaaaaattgacgtactttgaaatcgccttctaagttatcagcgaaatcttgtgtattcgcgaaccaagtagagctccaaggcttaacaataccaaggcgaataccatgtggatgtactttctgacccattgctattctcctactgattaacgatctgacactaccacagtgatgtggctagtacgttttaaaatacgatctgcacgacctttagcacgtggcataacacgtttcatgcttggaccttcatcaacgaaaatcttcgcaactttaagatcatcgacatctgcaccgtcattgtgctctgcgtttgcgatagctgactctaaaactttcttcactaaagctgctgcttttttgttagtgaaagttaagatttctaatgctgcagaaactttcttaccacggattaaatcagcaactaagcgagctttttgtgcagaagtacgagcgtaacgatgttttgcaatagtttccatcttttacctcttatttcttagctttcttatctgcggcgtgaccgcggtatgtacgagtcggtgcaaattcacctaatttatgaccgatcatttcatcagaaacataaactggaacatgctgacgaccattatggactgcgatggtcaatccgatcattgatggaatgatcattgaacgacgggaccaagttttgattggttttttatccccgctttccaccgccttctctaccttcttcaacaagtgtaggtcaaggaaaggacccttcttgagagaacgtggcatggcttatcctctttaattaattaaaaaattatttgccacgacgacgtacgatgaatttatcagtacgtttgttgtgacgagttttcttacctttggtttgaacaccccaaggtgtaacagggtgtttaccgaagttacgaccttcaccaccaccgtgtgggtggtctactgggttcatcgcagtaccacgaacggttggacgaatacctctccaacggtttgcacctgctttaccaagtacgcgaagcatatgctctgagttacctacttcaccgatggttgcagaacactcagctaatactttacgcatttcgcctgaacgaagacgtaaagttacatagttaccttcacgcgcgataatttgcacatatgcaccagcagaacgagcgatttgaccgcctttacctggttttaattctacgttatgaacagtagaacctactgggatattacgcattggtaatgagttacctactttaattggcgctgaagcacccgcttggatcgtatcacctgcagctaagccttttggtgctaagatgtaacggcgttcaccatctttataaagtactaatgcgatattcgcagaacggtttggatcgtattctaaacgctcaacaacagctggaatgtctaatttgttacgtttgaagtcaattaaacggtagtgttgtttgtgtccgccaccgatgtgacgagtagtgatacgacctaagttgttacgaccacctgttttagatttagtatctaaaagtgctgcaaaaggtttacctttgtgaagctcagtattaacaactttaactacatgacgacgaccagcggaggtcggcttacatttaacgatagccatagttttctattcctccgaaattactctgccgcaccttcaacgaagtcaagtgattgaccttcttgaagagttacataagcttttttccagtcactacgacgacctgattttgcaccgtgacgtttagttttacctttaacaatcactgtacgaacagaatctactttaacttcgaaaagttgctcaaccgcgttcgcaatttccactttgttagcgtctaatgctactttaaatacgattgtgttgcctttttctgcgttatttgtcgctttctcagagatatgtggtgctttaagcacttttagcaaacgttcttgttgaatcatgctaacatctcctcaatttgttttactgcatcaacagtgataaccactttatcgaaagcgattaagcttactggatcgataccttgtacatcgcgtacatcaactttgtataagttgcgcgccgctaagaataggttttcatctaagcttgcagtgatgataagagcgtcagttaacgccatatcttttaatttttgtactaaaactttggtttttggtgcatcgatttcgaatttatcaacaaccactaaacggtcttgacgaactaattcagaaagaatgcttttaattgcaccacggtacattttcttgttcactttttggctgtgatcttgtggtttcgctgcgaaagttacaccacctgaacgccagattggtgatttgatatcacctgaacgagcgcgacctgtacctttttgacgccaaggttttttgcctgaaccagacacttcagcacgagttttttgtgcgcgtgtaccttgacgagcacctgctgcataagcaacaactacttggtggattaacgcttcgttaaactcacgtccgaaggtagtttcagaaacgctgagtgctgtcgcacctacaacttgtaattccatctctatctcctagacttatgctttaactgctggtttaacaataacatcactattagttgcaccaggtacagaacctttaactaataataatttacgctcagcatctacacgaacaacttcaagtgattgaacggttacacgctcagcacctaagtgtccagccatttttttacctttaaacacacgacctggagtttggttttgaccaatagaaccaagtacacggtgtgataaagagttaccgtgagtagcatcttgagtacggaagttccaacgtttaacaccaccttggaaacctttaccttttgatgtaccagtaacatctacttttttaacatctgtgaagatgtctacgttgatttcttgacctaaagtgaattcttcaccttcagtacgaaattcccataaaccgcgaccagcttcaacacctgctttaacgaaatgacctgcttcaggcttagttacacgacttgcttttttagagccagtagtaacttgaactgcagtatagccatcgttttcaagagttttaacttgagtcacacggttggcttcgatttcgataacggtaactggaactgacacgccgtcttcattgaagatacgggtcataccaactttacgaccgactaaaccaatcattgtaataacctcttaattaacctaggctgatctgcacgtcaacgccggcagccaaatctaaacgcattaatgcatcaacagttttttctgttggctctacgatatctactaaacgtttgtgtgtacgaatttcgtattggtcacgagcgtctttgtttacgtgtggagaaatcaacacggtgaaacgttctttacgagttggtaaaggaatcggaccacgaacttgtgcaccagtacgtttagctgtttctacgatctccgcagtagattgatcaattaaacgatgatcaaatgcttttaagcggatacggattctttggttctgcattagaccagagctccattaaaatttagctaataaaaaactgaaccaccgcttaacaaattaaattaagggggcacagtcataccttgttatagtttccaaatcggaaacattgttacgtactaccctatcggtaataccacttgataaatgattacaccaagcgacttagactacgatgtcaaaagtggcgagattctacctaactcttttatcttttgcaagtgaaatttgcccaacagccttaaataaccataaatttacaaacacgaaaagctcaaaattcaaacaagcaggtgtttttttattctaaatattggttttttttctgatttttcgacgagtgtcacaaaaatattcttgttatttcattgcattatttggctgaaaagcgattatcttatttgagtgtaaataacgctcatttcctaatcaagatgtataattaattgaggtgtatatgaaatacattgatgcaaaaacacaacatatccgtaatcttctttacccaatcattggcgaaacgaaagcaaaaacctatttttcctattatggaataatgaaagataaagctatgtttgctttatacaaagatgataaattctatctacacataccaaatcattgcttagaggaaaacatagctaaaaatttatctcttcttctcgactctcagactggcattaatctaaaatccttctatttaatccctcccgatctacttaatgacttacaacaagtttcacattgggtcgtcgaaagtgtgaaagatattctccatacgaaacaaaatcagtatatggaaaagaaaaaatgtattcggacgctgccgaatatgacaatacaactcgaaaggacattaaaaaaactaggtgtctactctattgatgatttagtagataggggcgagattgatattttcgtcaacctccttaaaataggtgttgatgctgatcaagctttattatttcgacttcatggagcaataaatcgacaatatatctatacgatttcagacaaaacaaagcagaatttactcaatgatgcagataatgccttgtatgctgccggactccgaaagcgatttaatactagataaaatataattccatattggatttatgatccatatcacaaaaactaaaaaaacggacaaggaatggagcaatttccattcctttctttttcctagaatgctaggatttactcattgattttattattttattccactaggagaaaacaatgacattccgtattgaaaaagacaccatgggcgaagtgcaagtaccagctgataaatattgggctgcgcaaacagaacgttcacgtaacaacttcaaaatcggcccagaagcatcaatgccgaaagaaatcattgaagcattcggttatttgaaaaaagcagccgcttacgcaaaccatgatttaggcgtactttctgctgaaaaacgtgatttaatcgctcaagcctgcgatgaaatcctagcaaacaaattagataatcaattcccgctagtaatctggcaaacaggttcaggtacgcaatctaatatgaacgtgaatgaagtggtttcaaaccgtgcgcacgttttaaacggtggtaaacttggcgagaaatcgattattcacccaaatgatgatgtgaataaatcacaatcttcaaacgacacttacccaacagcgatgcacattgctgcatacaaaaaagtggttgaacatacccttccttgcgtaaaacgtttacaaaaaactttagctgacaaagcagcagcattccaagatgtggtgaaaatcggtcgtactcacttaatggacgcaacaccattaacattaggtcaagagttctctgcttatgcagcacaattagctttcggtatcaaagcgttagaaaatacgttaccgcacttggcagaattagcgttaggcggtacagctgtaggtacaggtttaaatacgccaaaaggctacgatgtgaaagtcgcagactacattgcgaaattcactggtttaccgttcgtaaccgcacaaaacaaattcgaagcactcgcaacacacgatgcgattgtggaaactcacggtgcattaaaacaattagcggtttcactttacaaaatcgctaacgacgtgcgtttattagcatctggcccacgttcaggtatcggcgaaatcttaatccctgaaaatgaaccaggttcatcaattatgccgggtaaagtaaacccaacccaatgtgaagcgatgacaatggtttgtgcgcaagtgttaggtaacgatgtaacaatttcatttgctggtacacaaggtcacttccaattaaacgtgtataaaccggtaatggcgtacaacttcttacaatctgcacaattattaggcgatgcgtgcgtatcattcgatgaacactgtgcaatcggtattgaaccgaactatccacgcattaaacagcaattagatcaatctctaatgcttgtgactgcattaaatacccatatcggttatgaaaatgcagcgaaaattgcgaaaactgcacacaaaaatggtacaacactcaaagaagaagcgatcaacttaggtttagtgaccgctgaacaatttgatgagtgggtacgccctgaagatatggtgggaagtttgaaataactgcttccataacatgggtttgcttttaaagcaaatttatatttaaaacatttttaaaggcatttttatattaattccaatatagaaatgccatttattctatcaatatttccaaatttcgattagaatctcaccgcttacacattcttattataatttgttcaaatttagagtaagaactatgtccaaaccaataaactttgtgatgatttcccctcactttccaaccaattttgaaacctttgcggtgagattgcgtgaaagtgggtttaatactttgggaattgcagacacaccttacgagcaattaagcgaaggcttacgcaactcactaactgagtattatcgtgtcgataatatggaagactacgaacaagtttaccgtgcggttggctattttgctcacaaatacggtcgcattgatcgtgttgagtcgcacaacgaatactggcttgagttagacgcaaaattgcgtactgatttcaacgtacctggctataaaaacgaagatatgttggcaatcaaaaccaaagcacaaatgaaagaagtattccgcaaagctggcttaaaagtggcgaaaggtcgtgtgtttaaagacgatgaagatgcacgcaaactggctaaagaactcaaattccctgtgatcatcaaaccaaactcaggtgttggggcgagcgatacctacaaaatcaaatcggcagacgaactagaagctttctttggttataaaaatgcccacattgaatatattatggaagagtttattgaaggcgatatcgtgacctttgacggtttaaccgacaaagacggtaatatcgtgttctactcaagccttgagtattctgaagtagtattagaaaccgtcgaaaaagataacgatatgttctactacattccacgcgaaatcaaagaagatttagttaaactcggacagaaatgtgtggacgcattcaaagtccgtgaacgtttcttccactttgaatatttccgtgttaaaaaaacgggcgaattaatgccacttgaaatcaactgccgtccaccaggtggtttaactattgatatgtggaactatgcaaacgattttgacgtattcagagagtacgcgaatatcgttaaagagaacaaattctactcaaacattacacacccttggaatgtggtttatatcgcacgtaaagcgaataaaaactacaaacacaccattgatgaagtatgccaaaaatacgcaggtaatattatcagcgttcaaactgtaccaggtgttttcgctaaaattatgggtgaacacggtattttggctcgtactgaaacaatggaacaaatgcgtgaaattgcacgctttgcccaagagaagcagtaatttatctcatattttcctttcctaaggaaaattatcaagtagcaactgtgtttacacacaaaaaagttattcaattttgacccacagattctgtggataagtagcgtgtagcgtcccatttttcattgcgtctaaccaacgcattcataatggttagcagtttacgcatacacgccataatagcgactttcttcgctttgccttttgcaaccaatcgggtgtaaaaggctttaaaaacaggttcaaagcgaattgccgatagtgctgccatatataaggcattacgaacaatcgctcgaccaccatagcaaaaggattttcctttccattgaccgctttcctgtggatgcggaataacgccaacgagtgaggcaattcttttgctgcttagcttgcctaattccggcaggcttgacatcatcacggcgacgcaatttttgccaacgcctttgatgtctgagataaggtcagctttatcactaaaatgcttactttggtcgtcgatatctttatcaagttcggcgattaatttatcaagcatttcaatgtgttgttggatattgtccaactgggtttcgtggctttgttgcaaacgatttagctctgctactcgcatatccacaagctgacgacggcgaaccacaagggcttccagctgttcttcttgctcagaaagcggaacatacaactgatgctctacttcgcctttaagctcacaagtgagcccatagaaagcgagattaaccgcatcttttgcatcggttttggctctcgtttgagattttgcaaactcactggctttcagtggattagcaataaatacacgataacctgctcgagcaagggcttttgccacgggaatttctaatccacccgttgcttcaagcgttatcagagccacattaaactggcttaaatagtccaaggtatgttgaatacctttagcgttattggtttcggttttggtctttttctgatgggaaaaaccaatcacgaaattgcgtttagcaacatcaataccacaataaatcggagcgttcatcggtaacctgccttgtattcgggtttatatttcaactgttcggttttgctgatgaagttatccacgcctacgctacagaacgagttttagctctagggacacccaagctgtggataacgttatggtttatgttgctagtttactataattttaatatacaagggacacactgcgtgtgtccactctatttttagaatttgacagtagcggacacacgcagtgtgtccctactgatatataaaggacaacaatcaatgcactttgaaagacgtagccactggagtggtgaactaggacgtgaaatgcatttcaacgtctatggacacgcaggcaaaccagttatcgtattcccatcatcaggtggcaaccaaaacgaatacggcaattttggtatgatcgaagcctgccgttcttttatcgatcgtggcttaagtaaattctataccccagactctttcgacagtgaatcttggcttgcagaatggaaatcgggacacgatatggcacaggctcataacgcttacgaccgttatatcatcaatgaatttgttccgttaattcgccacgaatctcagtgggagggagcaatgatcgcaacaggttgcagtatgggggcttaccatacgatcaactttgcattacgccacccagatctgtttgatactgcaattgctttaagtggtgtttacgatgctcgtttctttacaaaagagttttacggcgatcttgcaattcacattaattcaccgattgattacctttggaatcaacacgatagctggttcttagatcgttatcgtcaaaatcattatatcgttgccgtaggacaaggtgcgtgggaagctcaacacgttgaagacactcgtcgtctgcaagatgcctttgctagcaaaggtattcaaggctggttcgactactggggacacgatatggcacacgactggcctttatggcgtatgcaaatgccttatttccttgggaagttggaagagcagggaattatttacacctgattctctacgggctgtaaatccaacaaggatattttaaatggattattttcactataaaaaccaacaacttttcgcagaagatgtcgccattacagacattattgcgcagcatggcacaccagcttatatttactctcgggcaacacttgaacgccattggcatgcttttgataaggcatttggtgatcacccacacttaatttgcttcgcagtcaaatctaactctaaccttgccctgctaaatgtaatggctcgtttaggctcaggctttgacattgtttctcaaggggaattagagcgagtattagctgcagggggggatgcaagtaaagtggttttctctggggtggcaaaatcgcatagagaaattgctcgtgctttagaagttggcattcgttgttttaatgttgagtcggtttctgaattaaaacgcattaacgaagttgcaggacaacttggtaagattgccccaatttcattacgtgtaaatccagatgtcgatgctaaaactcacccttatatttcgacagggttaaaagaaaataaatttggtgtaagtgtcaaagaggctcgtgaagtttatcgttttgctactaccttacctcatgtaaaaattacaggaatggattgccatattggttcacaacttaccgaattacagccatttttagatgccactgaccgtgtgattgtgcttatggaacagctaaaacaggatggtatcgaactgcatcaccttgatcttggcggtggcttaggggtgacttatacggatgaaacaccgccacacccaatggaatatgctgcagcgttgctccataaacttcgaacctacccaaaccttgagatcattttagagccagggagagcgattactgcaaatgcaggtattttagtcactaaagttgaatatattaaacaaaatgaagatcgacgctttgccattgtagatacagggatgaacgatatgattcgccctgcattatatgaagcgtatatgcaaattattgaagtaaaccaatcgcttgtacgtgaaaaggcaatttacgatgtcgttggaccaatttgtgaaacgtcagactttttaggtaaacagcgagaacttgcaattgccgaaggggatctaattgcaatgcgttctgccggagcttatggtgcaacaatgtcctcaacttacaattcacgtccacaagctgtagaagtgatggttgatgctgataaagctcacttaattaaagctcgagcaagttttgaagatttatggcgtttagagaatatagtgcctctttgtaattaatttcattcggagtatttaatgcaaaagcaaccatctatttttggcggtgcctgtatcattgcaagtgtatgtgttggcggcggaatgttaggactaccgagtgctggagcaggagcatggacagtatggactgcagttgtaatgttaattacaatgatagttatgacgatttctggtgcaatgctacttgaagcatataaaaattatgaccttcgagtctcttttaacacagttactaaagatatactgggaaataaagtaaatataattagcaacatttctatctactttgtgggaggtattttgctatatgcatatataacctctcttggatatctatttcaagatttgcttaatatcacaaatcaactatctgctattatttgcgttttagtcttcggcggattagtttggcactcaactcgagctgttgatagaatttccatcattctaattatttttatggtattgagcttcatctttagcatctgggggcttgctactaatattaatttttcctatctttttgatactgtcaatagagagcaaaatacttatgcacagtataccatgatgatgttacctatagctctgacttcttttggctaccatcattcagtctcctcaatgagggcatactacggtgaagaaaaaagagcatctaaagccataatttatggaaccatgattgctctggttttctatctaatatggattggttgcgtatttggcaaccttccaagagaaaaattcacccctgttattcaaaatgaaggaaacattgatgtactattaaatacattaggcaatgtaataaatacaccaagtataaagcaagcactcaatgcattttctatcgcagctattttatcttctttcattggggttggacttggagtttttgactttttagcagatctcttccaattcaaaaacgataaattaggtagaacaaaaagttggtttgccacatttataccgcctctcctattatctttactctttccatttggatttatcactgcaataggatatgctggagccgtggcaactatttggacatgtattattcctgcgttactaatatataaacaacgccaaaaaacaagactatatggatttaaagcttttggtggaacaccaatgatttggtttattgccttatttggagtcttcgttgcgattttccacatcttaacaatgctaaagatgttacctatattcataggatagattatagatatggtctatagctaatttaacattcaaaataacataatgaaaaatcaaaataatttcctacagcacacgccaatgatggctcaatatctccaactcaaagcacaaaatcccgatattcttctgttctatcgtatgggcgatttttatgagttattttacgacgatgccaaaaaagcggctgcgttgttagatatttctctgactaaacgtgggcaatcagcaggtgaaccaattccaatggctggggtaccgtatcacgctgttgaaggttatttggcgaagttggtggcgttgggtgagagtgtggcgatttgtgagcaaatcggcgatcctgcaaccagtaaaggccctgttgagcgtaaagtcgtacgaattatcacacctggaacggtcagcgacgaagcgttgctaccagaacgccaagacaatttggtcgccgcaatttatcaagaaaaaggcgttttcgcccttgcgacattagatatggcttctgggcgttttttgattagcgaattacctaacaaagaggcactgtctgctgagttacaacgcacccaacctgccgagattttgtatcctgaagatttttctgatgtaggtattttacagggttacaaaggcttacgccgccgacctgtttgggaatttgagctagttacagccattcagttgcttaatcgccaatttgggacacaaaatcttacaggttttggagtagaaaaggcggtggttgccttgtgtgcggctggttgtgtcttgcattatgctcaagaaactcaacgcaccgcactgccacatatcaacagcattcatttggctcaaaatagcgatactgtcttacttgattcggcaactcgcagaaatttggaattaaccaccaatctggcaggcggtacagaaaacacacttacatcggttttggataaatgcgtcacctcaatggggagtcgtttactcaaacgttggatccatcaacctattcgtgatttagccaaactgcatactcgccagcaaactattttggcattgcaaaaaaatgaacgtatcgaaccgcttcagcccttgctacaacaagtaggcgatatggaacggattttggctcgcgttgcattacgcactgctcgccctcgtgacctaacccgtttacgcacagctttagagcatattcccgatattgtaaaacattcacaacatcagaccgcttgtttagacaatactttgcagcagatcgccgattttagcgagctattcgagctattaaaccaagcaatcattgataacccaccgcaacttatccgtgacggtggcgttatcgccgaaggctacaatgctgagttggacgaatggcgaagtttggcagaaggggcaaccaaattccttgaagatttagaagcgagagaacgagccaaaacaggcattgatacccttaaaatcggattcaatgcggtacacggctactatatccaaatcagtcaaggacaggctcacaaagctccgatccactatgtccgccgtcaaacgttaaagaatgcggaacgttacattattcctgagctgaaaacctatgaagataaggtattgaaagcgaaaggggcatctcttgcccttgaaaaacagctttatgatgaactgtttgaactgttaatgccacgtttgggtgaattgcagttggcaagctttgtgttagcagaacttgatgtgctgaccaaccttgccgaacgtgccgaaagtttgaattatgtaatgccaagtttcagccatcagagaggcgtgaatatcaaaggcggtcgccaccctgttgttgaacaagtactgaaaacaccgtttatcgccaaccctgtactgctcaacccacaacgccatttgctgatcgtcacaggtccgaatatgggcggtaaaagtacctatatgcgacaaattgccttgattaccttaatggcatatatcggcagttttgtgcctgcggacagtgcagaaatcggaccgattgaccgtatttttacccgtatcggtgcttctgatgatttagcatcaggacgctcaacctttatggtggaaatgaccgaaatggcgaacattctgcaccagtctagcgaaaacagccttgttcttgttgatgaaatcgggcgaggcacctcgacctacgatggcttatcactcgcttgggcgtgtgccgaatggttagcgaagaaaacccaatcgctcaccctatttgccacccactactttgagctaaccagcttaccaaaccagctcaaaggcgttgccaatatccatttagatgcgttggaacataacgacactatcgcctttatgcacagcgtacaagaaggggcagcaagtaaaagttatggtttagccgttgccgccctagcaggcgtaccaaagcaggtgatccaacttgcgaaacagaaactcacacagcttgaacgactttcgcaacaaacggcacaattagacgcaaatcaacagcaagatttactcttttcggcgaatttgcaaaatgctgaaccaatctcaccgcttatcgaaccgtccaaagtcgaacaagccctcgcagagattgatcctgatgaactcacaccgaaacaggcgttggagatgttgtatcggttgaagttacttataaaataaagacaccttggaatgtagacaaaattggagattataataaaaagccccatttctaactgctcaggaactataaaacggcactaagcctttttatcattgaatttactgagtttttgaatgatcacatttaaattagtatggggctttacctagaatgtgagataggtgttagataaaatgtaagtcatcttttcctcttttcacgacccttgtataatagctgagcttttttaagcaatgacaatttattttatttcagatatcacaagggccttattatgaaaaacatcttaacttggcctgtggttgcaggtgctgcacttggtatcgttgggctgcttgcgggtgtttttgcagggattttcttcttcaaacgtggattttcgcacggtaagtccggcgaacaaagtacagcatccggcatagtccctatttttattgtgatcgccctgtttattgccctgatcacccaattccgctttggtgaaaacttacccattttcttctctgaaaaagcccctgccgcccaacatgccaacctatggctttcattaggtgctggtgtgcttgtcggtatcgttatgcaacgctctcgtttttgttcaatcggtgcattccgtaattttatcttatccaaagacagctatctgctaaacggaattgttgcattggtggtatgtacgtctataaccaacctaatgctgggtcagttcaaacttggttttgaacaacaaccaattgcccataatgatgttgtatggaacttcctgagtatgacactgtgcggcttatgtttttctttcgcaggaggctgcccaggtaaacaactggtgcatttaggtgaaggtaataatgatgcggcacttttccttgtcggaatgctattaggtgcggctgcagctcataacttttcgctggcagcatcaggtacaggcatatccacctttacaccttatggggttggacttgggctgcttttctgtctctatattggatttaccaataagtctactcattagaactagggtactgtgccttattaatgaaatactgacgtacttcaggtacagtacccgattatacttaggttatattttctaacccaataattgtgagataagtctaaagactctatactgaatcagtatagaatctttagctagcggtcatcacaaatgatagtatcgcaaaactttttaattaatgattacatagaaatttgaaccattacgcaaaatatttaaggcaatggcagatggattggaatcaagaaccttacgcaactcgcctaaattctcaacggtacgacgatttacaccaacaatcacatcgccttttctaaatcctcttgcctcagcgagtgaatttttttcaactttagtgatttcaacgccttttattcctttttcgttatagtttgaaaactcagcaccatttaaacttggtaataaacttttcgcacttgttttggtttgttcgtcagattgtaatgtgactttaacatttttctctttaccatcacgtaaataggttaattcaatttctttgccagctccagtagtcgctacttttgctcttagttctgcgaaactacggattttttgaccatttagccctgtaatcacatcacctgctttcaagccagctttagctgcagcagattctggcatcacttcgctgacaaaagcaccttgttgtgcattgacatcaaaggctttagctaaatctgcattgagttcaccgcctttaataccaagtaagccacgcttcacttctccaaactcaataatttgctgaacaagattgtttgccatattacttggaattgcaaacgcaatacctgcattaccgccacttggtgaaataatcgcagtattgatgccgattaattctccatttaagttaattaatgggccgcctgagttaccacggtttactgccgcatcggtttgaatataactctcatacccttcatcaatatcgcctgttgaacgacctaatgccgatacaataccagatgtcaccgtttgacctaacccaaatggattgccgatagccacagtgaaatcaccaacacgcaatttatctgaatctgcaattttaatttcagttaaatctttaggattttctaattggattaatgccacatcagacattgggtctgccccaactaatttggctttaaattcacggccatcttctaatttaacggtaattttatcggcattatcaataacgtggttatttgtaactacatagcctttcttcgcatcaataattacaccagaaccttcccccttaaactgacgaggagaacctccatctctaaacatatctggaccaaagaaaaattcaaattcttcgggaactgcacgtcttgcggatactttggttttaccttcaatagcaatactgactaccgcaggacgtaccttttctaacattggagcaaggcttggtaatgcttgtccgtttacagcagtaggcaatgtagcgtgagctaccattggtgcagaaagcacacctaatccgagtactaaagaggttaaaagtgattttttcattgttgctttcattgattatccttactaaatttatgatttatattatttcttatttcaaacccagtgagttcgtattgcctttgactctgattttatttgtcagttctcagttttgtggttaattgtttaaaaatcattctttcagctaattttaatcaatatttgaccgatataattacaaaaatgtgaactacttcacattttatataaacaaagttttgtaggctaatttaccttaaggtaacaaattaatagaatacactgcctttttaggtttaacttatattcaactttttattcacaggatctccattatgttgtggttcttattttgcgtagccgtattaatcctaggctacttcgtttacggtaaaatcatcgaaaaaattttcgtgattaacccgaaaaaaacaacgccagcttacacaatgcaagacggtgttgactacgtaccaatgtctaaaaagcgtatttggctcattcagttattaaacattgcaggaacaggtccaatctttggtcctatccttggtgcgttatacggaccagttgcaatgctttggatcgtattaggttgtatcttcgcaggtgcagtacacgactacttctgtggtatgttaagtgtgcgtaacggcggtgcatcaatgcctaatttagctggtaaatacttaggtcgtccagttaaagcctttattaaccttttagccgttgtattacttcttctagtaggggtagtattcgtagcaagtcctgctcaattattaagtacaattactgttgacgtatttggttcagcaggtggcgcactctctttagataacgctgaagaaattgcgaaaacagcgacagtcgcaagcgacatcactgtatggggtatggataaaccaacggtaatcacagtatggacaatcattattttctgttactacattcttgcaaccttacttccaattgacaaaatcatcggtcgtatctacccattcttcggtgcgttactcctatttatgtcagcaggtatggtgtatggtttagtgactagccacttcagtgcaacagaccctgttgatttcttccgtactattgatggaatgagtgctgagaagttcttccaaaacttccaagttaaaggcgatgttccagtttggccgttacttttcttaaccatctcttgtggtgcattatcaggtttccacgcaacacaaactccattaatggctcgttgtgcagaaaacgaaagcgaaggtcgcttcattttctacggtgcaatgattgctgaaggtgttattgcgttaatctggtgtatggttggtttagcattctatgaaaacccacaagcgttacaagatgcaatcgtagtaggttcaccttctaaagtggtatatgattcttctctttacttcttaggcttcgtaggtggtatcttcgcagtgttaggcgtagttgtattacctatcacatctggtgacaccgcattccgtgcagcacgtttaatcattgcggagttcttcaatattgaacaaagaactttagtaaaacgcttaatgatttgtcttccattatttgctatcggttttatcgtttcaaaaatcgacttcagtatcttatggcgttacttcacttgggcaaaccaaacgacagcaatggtaatgttatggacagcagcggcttacttatatcgctacaataaattccactgggtatgtacagttccagcggtatttatcagtaccgtatcattcaccttcttagcgtacaataagattggtttcggtttagattaccaattatcggtatacattggtttagcattagcagcagcgtgcttagttgcattcttcacaatgattaaacgtgaaggtcaagaagacctggatgtttatattgatgatacaactaaagcataatcattgaattgttgaactataggggcgaattttcgccccttatttttgtggatgaacacagttgctacgaaaaaattaagtgtttgtgcaagtgctatataatactggataagtacagaaatcaaagctctttttttgaaatatgaatttggacgaatggcacatctagaaaacagacttatcaacagcttactgttaaatacgagttttctcaatgttttttaatccctgtaattcgacaccattcttctttttctatgatagaatcaagtttaaagctattttggtaagctttacaaacggattctgcttgtgtagcaagaatacctgataaacctaaattcccctgtggttttactaacgtgataatttgaggggcaagttcttttaacgggcctgcaagaatatttgctataacgacatcagcaattaggttttgcggttgatcttttgtaagaaatagttgcaatctatccgctacaccatttacttccgcattgttctgactagctaaaattgcttgtggatcaatatcgatacctattgctttttttgcacctaatttaagagctgcaattgctaaaattcccgaaccacagccaaagtcaataaccgttttatctgttaaatccagactgtctaaccaagctagacaaagtgcagttgttgggtgtgttcctgtgccaaatgctaaaccaggatctagcattacattgactgcatttggatcgggaatttctcgccaacttgggcagatccataaacgtttaccgaattgcattgggtggaaattgtccatccattcccgttcccaatctttatcttcaatttgttctattttatatggaaagtcagtagctacaagtttactttttactaatgtagaaacaatctctttcatgtcagtttctgcatcaaataaggcaacgacatcagtattaccccaaagacgagtttctccaggaagtggctcaaaaattggcgtatcttggctgttcataaaagtcacggacactgctccaatatcttctaaaaaatcgctaattttctcagcttctctatctgtactatttaaacgaatttgtacccaagccattttgttttccttcattttttaataaaatgactattatagccttgcatagcaggagcaaacaagattaagtataagttaatccaaatagaactaaataatgtatcttatttgaaaataacaagatcgaatattttggtctaaaaatgtatatttttaaaatttactccagtgatttattactaaatcaacgcatctctatacacatgaattacatatggatatcattgccaccatacgaaattgatacatctgtactggcgtattaaataaatctttcatcaaaccactccttgccatcgcaggtaatccgattgaattatatagcttttttctcttaatctattcagggcaagtttatagtaaatatctttttcggttcgcacaaaataatgggaaatgacattatttgaaagcgtatccattaacactaatacgccaaaataacgtccgaaaaacgttgtatccataatgatattcaggtatcgatttgaaggcagttttaaagccgttttaggcgctttattgatatatctttgaatcgttctgactgaacaatgatatttaacggcaagttgttgataggtttgttttccagatgtgtaatcagtccaaatttttattggatctaatttattctcaaggaaaaatgttttatgacacttatgacaaaaatatcgttgaatattatttgatgtaccatgtttctttattttcagactttggcaaaatgggaagttttttgttcatatttcaaaaatagggcttaaagccttgtactataagtactttaagccacttttcagcaactattttgtctattacacctttttattaaccatgtcacaatatcattaaaaaaagagctggtgattatgatctgcaccccaaaagttggactaaacaaccaactaattaaggtgcagatcaaagtttctttgggcgtttaaaaacggaatgttactttggcaaacggtttgagacctttgagcaactggaacaagctattcacgaatatattcattattacaatcatgggcgtattcaagtaaaattaaaaggactaagccctgtggaatacagaactcagtccttgaactaaatcagtctaacttttggggggcagatcattataaccagctcttttgactttgtaagatgaaatgttatgtgatcagtatagtatttagaactaatacattgccataatattgattaatttagtgtagtatttgtagtactctcaccgttttcttccgcttgttgacgagctaaatagtccataaacaatgcatcaaagtttactggtgaaagatttaatgcagggaatgtaccacgatttactagacttgaaattaactctcgtgcataagggtaaagcacttcagggcatttcgctgcaagacagtgtgccaattggataccttcaatacctttgatggtaaatacacccgcttgttttacttcacagatgaatgcgacatcgttgctgtcttccaaagttgtttgaacattgatatgtaaaaccacttcgtaagtatcttcaccaatttcacgcgtttctgtatcaagatcaaaacctaactgaggtttccattcttgatgaaaaatgtttggtaaattaggcgcttcaaaagaaacatctttgatatagatacgttgaatttgcatttcaaacggagtttgttgctcttcagtagcaacttgattttcttcagccatagtcattccttaattttaatgtattgaattatttatgtttttttacaagcggtaagttagccgtacgccagcctgcaatgccttcttttaatacatagactttatcgaagccctgtttcacaagttcatttgcaagcccacttgcacttaaaccattcgcatcaacaacaatcacaggacgatctttatatttttcgatagcctgtgtttttttacctttgatgtcgcttggaattaaatgcacgctctcaatgatatgaccgtgtctaaattcatcatcagaacgaacatcaactaacactgcatcttctttattgataagctgagttgcttgagcattatccacaatcttgaatttgctggttgcacctttatagaaattgatgattaccgcaataaaaagagccacccacgctacaaccataatggtgtggttagcggtgaactgctgaaattgttctgcaaaagtaagttgttccataggtttctctctaatgtaaatgaataatggtagcgaaagtaactcgccagcgacatttaatataaggcacgctaatgcgtgccaaattattaattagagaaattagccttgatgtgacattacttcatcaaatgaagatgctttttctgtcacttttgcttttgcaagcacagcttcaaccgcttgctcttctaatactacgttacgaatgttatcggttaaacgtggatttttcgcatagtattcaactacttctgctggttgttcgtaagctgatgctaattcggtaatagtttctttcacacgatcttcatcaacttttaattcgttagatgtgatcacgctcgaaagtaatagacctacttgaacacgacgttttgcctctacttcaaacaattctgctggtaattgtgctgccatttctggcttgctaccgaaacgttgaactgcttgctgacgtaatacatcaacttcttccgctactgctgatgaaggaacttcaatgtcgttgtttgctaataagccgttgatcacttggttttttacacgagtagttaatgcattttttaactcacgttgcatatttttcttgatttcaacacgcaactcttcaacggtttttgctgaaccaaattttttcacgaactcttctgttaattcaggaagaacgatgttttctacttttttcaaggtgatagcaaattttgcagctttaccttttaagttctcagcgtggtattctgctgggaatatcacatcgatatcgaattgttcgccggctttgtgaccaacgataccctcttcaaaaccagggatcatacgaccttgccccattgctaatacgaagtcagaagccttaccgccttcaaactcttcgccatctactgaaccaacgaaatcgattgttacacggtcatctgcttttgctgcttcagtggtttctgcaaatgttgcttgttgtttgcgtaacacatcaaccattttgtctaaatcagcttctgtgatttcaaccactggtttttctacttcgatgttttctaaaccttttaattcaacttctgggaatacttcaaaagtcgctacgaatgagaaatcttgacctggttggtagttgtttggtgtgaatgttggacgacctgcaaggttgattttctctgcaatcactacatcaaagaaagcacgttgcatctcttcagataatacatcttgacgagccgctaaaccgtaacgttgttcaatgattgagtgaggaactttccctttacggaaaccatctacacgagcatttttcgcatagccttttaattgttctttgtaacctgcttcaattttatctgcagctacggtaactgttacacggcgttgtaagccttctaatgtttcaatagaaattgacattcttaaacctcagtattaaaaaggatttgattataaaatacaaatagatagcaattgtaacgtcctgtaaacacaatgtcgagaactttagtgattgaaataaaatatacgaacactcaataattaatatacttttattgtaggaataatttattcaatgtgaataaagcatatgcttaccaataagcatactgtacaaattctttataccgactatttctctaactaaagagaaataagcacaataaatgatatatctcccttagggttaatttactcacatcccaagaaaagtctattttcaatagctaaagatatttcaaaaatggagtttattgcgtttcatgtaagtacaaataaatattaaatctctacaataacaaattatttcatttatccattttattttctcccaaactatgttctaataccccccaacaacatttccgtaacatttgtattaaggtttaatcaatgttcagtggtctttttatcgggatacttctcggttttttcttacaacgtgggcaattttgcttcgtgtccggttttcgcaacatttatacccagcaaaactttcgcttttttaccgcattgttaattgcggtgtccattcaatccatcggattttttagtttaagtgaattagggctgatcaccattccgaataccccaatgcctctgttagcaacggtgttaggcggttttgtatttggtatcgggatgatcttggcaaattgctgtgccagcggtggttggtttcgcaccgaatttttaccaaacactggcacccttttgctaccgccgtgtgtatcggtctgctcggcgtgttggcgtggtttgtgagtgagcagtacggcagagcttacggctatggtgtcgctgtgccgaccgccaatgtggtgcaatatatcgtgatcgggcaacagcgttatctcaactggggaacttacttcgttctcggcattttgctcggctcttttattgccgcaaaattgagtggggaatttgaaatccgcgtgcctgaacccaaagcgattatgcaacgaatgttcggcggtatcctgatggggatcggtgccagccttgcaggcggttgtacgatcaccaactcactggtttcgaccgcttatttttcgtggcaaggttggcttgctacgctgatgattatgctcggctgttggactgcaacttactttattaagccaacgcaatgtcgtatttaatttaataaaccagcctaaattccctcccccgtttacgggggagggtgaggcccctgtgtataaccttgccaatccgcaacaaattgaacaaaacctgttacaacacgggatcaccaaagataaaactattgtgctttattccgacaatccgcttgccgcctatcgtgtgttttgggcgttgaaatgggctggtgtagaagatgtacgagtgttaaacggcaatcttgccacttggatagacgcaggttttccaacggaaaccaaagtcaatcagccactgcctgaaacggcgttcggcacaaccattccggctaatccgcagatcaacatcagcccaacctgagcaggcttacgcccgtcagcaacaaggcttgaagctcgttagcacaagggcgtgggaagagtttatcggcgaagtgagcggtgatgaacatattcaagcaacaggtgaaccgcagggagcaatttggggcttttcgggatcggcaccgtcaaatgtcgccgatttttacgaccctgatggcaccttgcgtaacccgaaagagatcgtggcactgtggcaaggacagcatattcaacagggcgatcaactggcgttctattgtggaacaggctggcgagcgtccgtgccgtggtttatgacccagcttctcggctggcaaaatacggcggtttatgacggcggttagaatgcgtggcagatggactcaaccttccctgtacagaaaggcgcgccgaataatatggcgaagccggatagtaaaaactaacatataaccctcgtaagcagtcagtttgttgcaataatttgtcataatctgaccgcttatatttttcgttctattgcttcgctatataaaaatcatattaaaataaaagaacttttcttcctagattacagtcttagcagcatatcttttatttttggagagcatgatgaaacgcactacacttacaaaccatcaatttttatgtgccagaagcctattttaacggcggttcaatcaatggatttacggctaacaccgcaccgattttcttacctaatgcggtcggaggctatatgcctgccaaagcagcaacctatgataaaaaaggtttcggctcgaatgcagataaaccgaatgcaatcgtaacagctctctctaaaggctatgtggtggcaagtgttggtgctcgtggtcgaacccttgagaaagacggcaaatatacaggaaaagcccctgcggcaatcattgacttaaaatcggcggttcgttacttgcattttaacgatcaacgaatggcaggtgatgcgaataaaattatctcaaatggaaccagtgcaggcggtgccttgtcggctctattaggggcaagtggcgatcatcgcgattatgcggaatacttcaaacaagttgaggcagcagaagcgagcgatgcgatttttgctgtatcagcttactgcccaattaccaacttagaaaatgccgatactgcttataaatgggaatttaatggcttaaatcaatttagtcgcattgatatgagccgtttatctgctgcaggttacaatgatcgctctcagccaaaacctcgcattgaaggtgaattaactgcagatcagatcaaaacttctcacgaactaaaagccgcatttcctgcttatgttaatagcctgaacttgaaagatgaaaaaggcaatttgcttacccttgataaagaaggaaacggctcttttaaagagtatgtcaaacaggtgatagtgagagcagctgatacggctcataaaaatggtacgaatttaagtgataagtcgtggctcactttgagtaaagatggtgtggctgatatggattggaacggttatattcattcagaaaaacgaatgaaatcgccacctgcctttgatgcctttgatttaagctcaggggaaaataatctctttggaacggaaaccgttaataatcaacattttacctcttacgcccttgaacgcagtaccgcaaaaggcggtatggcagatgcacatatcatcaaaatgatgaacgcaatgaactacgttgaacaccctaaagccgcagaacattggcgtattcgtgtaggcacttcagatcgcgatacttctcacgcaatcagtgcaattttagccattaagctcaatatggcaggtaaacaggtcgattatgaaaccccttggggcattccgcacgcaggggattatgatttagatgcactgtttaagtgggcggatagtattgcaaaatagcgtattttaaatagactaaaagttgctaaccattgtaaaagcaaaggctagcaactttttctcacacatattgatgttattacgtatttttcatcaatcgtgaaattcttccctcaaaaatttcctcatcacggattgtcataacctcgcagccatcttttgtaacaacaatttggtgttcatattgtgcagaatgactacgatctttagtttttaccgtccacccatctcccatcaggcgtatttcctttttcccagcattaatcatcggctcaatagtaaacaccataccttcttgtaataccactccgccatcatctgaaaaataatgtagtacttggggttcacaatgaaattgatcgccaataccatgtccacaatattcacgaactactgaaaatccctctttttctgcaaattgctgaattgctttaccgatttgatttaaacgaatacctggttttaccgcacgtaagccaatataaagacattcttgagtaacctctaacaagcgcttatctttaatcgttggctctcctacagcatacatttttgaattatccccataatagccatcctttatcacagtcacatcaatattcagaatatctcctttcttcaatttcttttctggatttggtatgccatggcacacaacttcattcaatgaaatacatgttgcttttggatagccatgatagcctaaacatgcgggaattgctttctgtacttgttcgatatattcatgacaaatgcgatctaattctccagtactaattccttctttaacatagggctcaatcatcactaaaacatcagaagctaacttacaggcaatacgtaacttttcaatctctgcctctgaacgaataggtatattcttcatttttacatctctctacaattaaataaaataaattatatcctctttagccaaataattcactccatataagtaagcattaccttaatgaatatctatatttgttactcaaccgtcactgacttcgccaagttacgaggctgatccacatcagttcccttaatcaaagcaacgtgataagaaagtaattgtaatggaacagcgtagaaaataggagctgtcacatggtctactttcgggaaagttaataccgtataaccttcttggctactaaaccctgcttcactatcagcaaagacatacatttgaccgccacgtgcacgcacttcttcaatatttgattttactttttcgagtaaatcattttctggtgcaaccacaatcacaggcatatccgcatcaattaatgctaacgggccgtgtttcaattcgcctgccgcataagcttccgcatgaatataagaaatctcttttaattttaatgcagattccattgcgataggatagaactcaccacgacctaagaagagcgtatgatgtttctctgcaaagtcttctgataatttttcaatctctttatcaaatactaatgcactttcaatttgtgctggtaagcgttgtaaagatttcacaatttccgtttcttgttcagcagagacattgccttttaaacgtcctaatgctgccgttaaaagtagtaaacaggttaattgtgttgtaaatgctttagttgaagcaacgccaacttctacaccagcacgggtcataaaagcaaagtcagattcacgcacaagggaagagcttgccacattacaaatcgtcattgccgccataaaaccagattctttggctaaacgtaatgccgctaaagtatctgcagtttcgcccgattgagaaatggtaattagcaaactatttggacgagtcacaaatttacggtaacgaaattcagaagcgatttcgacatcacaagccacgcctgcaatagattcaaaccagtaacgagccaccataccagcattgtaagacgtaccacaagcaacgatttgaatgtgttcaactttctttaagatctcttcagcattgttgctgattgcttcaatatttactttaccgttcgcaatacgtccttctaaagtattcataattgctactggctgttcaaaaatctctttttgcatatagtggcgatattgacctttatccgctgcatcagactcaaagttaccttcgtgaacgtcacgctctactttttcacctgcacgattatagatatcgacagtacgacgagtgatttctgctacatcaccttcttcaaggtagataaaacgacgagttacacttaataatgcaagcgggtcagaagcaaggaaattttccccaacacctaaaccgatcactaacgggctacctgaacgagcaaccactaaatgctcaggttcatcttgattcattaccactgttccgtaagcaccacgaagctgtttgaccgcttttcttaccgcatcgagtaaatttggcgttgtacggaattcccattccactaaatgtgcaattacttcagtatccgtttgtgattggaatacataaccgcgttgttgtaattcagcactcagttcttcgtagttctcgataataccgttatgaacgacggcaattttgcctgaacggtgtgggtgagcattaacttctgatggctcaccatgtgttgcccaacgggtatgtgcaatccctgtgccgcctaaaagtgggtttgcttcaagtgcttcatctaagaatttcactttacccacacggcgaacgatctgtaagttatgatcgtttcctaagactgcaacaccggctgagtcataaccacgatattctaaacggtgtaaaccatcgactaaaatttctgcgacatcacgttgtgctactgcacctacaattccacacataaatttgctttcctatttttgcttaatttgtttgttgtttattttgcaacaatcacctcaacccctaacgcctcaatttgttgtttgacgtttggatcaagctgatcatcagtaattaatttatcaatttgttgccattccaattcaagatttggcatttttcgtccgattttttgagattcaatcagcacaatcacttcccttgacacttcagccattacttggcttaagccaatgagttcattaaaagtggttgtgccacgggttaaatccagtccatcagcaccaataaaaagctgatcgaagtcgtaagaacgcaatacatttgcagcaactttcccctgaaacgactccgaacgagcgtcccaagttcctcctgtcatcaggactgtcggttcgcattctaaagcgattaattcatttgcaagcgcaagcgaatttgtcattacaactaagcctgaatgatgaagtgctttgactaacgttcctgttgtactcccgctatcaatgataatgcgattatgatctcgaatttgatttgctgccgcactagcaatagctaacttttgtttcgaaagttgctcttgcgactcttcattcatctctgttggtaattttattgcacctccgtagcgacgcaataaaaaaccgctttcttcaagagcggttagatccttacgaatagttacttcagaggtttcaaataagtgcgccaaatattccacacttacttcgccttgttcttgaacaagacctacaataatttgacggcgttgttgtgtatttcgttttgacacttaaattttccaaatatctttcgattcaaaacatgattattatatagaggaataattagcaagagaagtaaaacttgtagcatcattctgaatgggagaacactgtaacatctataattaacaaatatcttgcatctataaaatgtaaaggaatagattgaaacctaaaataccaatacccacactaaatagaacatttcttaaccatacatagctcactactactcctactaatgctattatttgagcgataaataaggtataaccttcattacttttcggcaaacttaagctggtgagtaccagtaataccataatcacaagcggtaacattttgtttaatttttgcaaaattggcgaagatagtacagtttttggtaagaataacggcaaaaagcgacaaagttgagtgcctaatgccaatgcaatcaacatataaataatattttgtgtttccattaggcttgcccttttttctcagtgaatgattggggtaagaaagcgacaatgataatggcaatgataattgccacaagcaaaacgcttgtttgtgtgatttgccctgcaagtaaaaatccaatcaatgcaataaaaatcggcttccactgcttttggctactgtattgttcataagctaaaatagcgaataagcaaggcagtgcaaaatctaaattgggaatatattgggaaacagaatcacccagtaaaatgccaacaatagttgcaaatgtccaataactcattcctaagatactgattttgaacatcatcgcctgacgagtttcttgtggtaaggtggttaatacgccaaagttttcatctgtcagatagcttaatgcaaaaaagcggttgagtttttctttgggtaatgatgaatgcatattaagtgtataaaaaataaaacgtaagctcatcaataaagtgctgagaaaaacggaaactactcccgctccagaaacaaaaaagggaattgctgcatactgtgctgtgcctgaaaaaacggtaaaacacatcacaaccgtaaaccacgctggcattccagcattggttgctaacattccataggcaatacctgcggcaaggtatcccataaatatcggtaaagtgagttttaatgcactttcccaactattttccgtgttaaatgacatagagctccagcgtaaatttatgcaatgagtgcattttcaaaaaaatacaaacactctcttataacataaacctttataccaaatattaagccagaatataaagaggaccttttactccacaagatgttaacccgattattatcaggaagagcataaatatcagttttttcattatttatgtatgtattgttaattacgttgggtaaatgttacgttagaatagtataaaatgcaaaatcttttaagagagatgttgccgattgggtatttagcacaacaacagaataaaccttaccattacaataattgatatgcttgaataccacaacttctcccgccctcgcttgtctttcgcatactaccgaaacataccaacttaaactgctttttatcattgaaatacctattaccaactttttgctcttatattcaagattatttacgacactgatttaaaatatctaactctttctgataaacagagagcgataaatccatatccatcatacctatcacagaatgaaaataattgtcatgagaataggtttttgttttcgcattttctctaacgcaatttagatcaaaaggttcgtttttaatccactcttttgaaaaccacataatcatcgggactttggtttgatattcaggtgcaatagaataaagccaagggataagtttaattttgttcatagaaaggatttccgaaaatcaggcataaaaaagcggtcagcttctgcaaattttttacaaaaacagaccgctagtgaggataaattatttcttagtaatctgttttacatccacttgaactttgttccaatcgttatcaactttaccacgaatttgaatggtatcttgaggaccgatatttaaaccgttccaagcacgtttgcttacatcaatttcaatttcgcccgttgcgtctttaaagataaactcatctttgtcgatttgtttaacgatttgcccttcaagtagtgcaggggtgtcatccgccgctttaagtgcatctgctacgctcttcactgcaatactttcatcaaagaaaccctgtgattgatgtgttcttgctttgccatcgtgatagccaccgtgacgataatcatcatcaccttttgccattgatacagtagataccgctaataatgttgttaagataattgcttttttcatagaatactccgaatagttaaaataataattatgaataacgaaggctcttgcctttcgttgagagtattaaagcaagtaaatcttaaaaaattcttaagaagtaaaaaattttttatatctttattgataataaagatatctaatctctatttacattatgaattggaatcgactagagaaatgatatacaaaagtactagaagaatactactattgcctttttgaggcccaataaagggagaaaaataaagttttagtattgaataaatagaataaaatcaagttacgcattactataaaccgtcttttcatcaagccaacggcgaattagctgtttagctgtatcgggatattttaacgttagctgtttagcgtagctctgcaccaacgggatcatcttacgatctcgcattaaatttgcaatcttgaactctgccattcccgtctgttttgtgcctagcacttcgcctggtcctcgaatttccaaatctttttcagcaatcacaaagccatcttggctatctctcagcacctgtaaacgcttagttgaaattttacccaatggggctttgtacatcaagacacaatgggaagccgtcgccccacgcccgacacgcccacgcagttggtgcaactgtgccagccccaagcgttcggaattttcgataatcatcaaactggcattcggcacatctacgccgacttcaatcactgttgttgcgactaacaaatcaatatctgccgccttaaattccgccataatcgcctgtttttcttgcggtttcattcgcccgtgaaccaagccaatccgcaaatctggcaaggctcgttgcaaatcttcggcaatcgccgctgccgcttgtgcttccaatacttccgactcatcaattagcgtacagacccaataggcttggcgtttttcatttttacaggcttgataaacacggcgaaccacttcatctcggcgatcttctgaaatcgccaccgtcgtaatcggcgttcgccctgggggaagttcgtcaataatggacgtatccaaatccgcatagacagtcatcgctaaggtgcgtggaataggcgttgcggtcataatcaactggtgcggatacacatcgcccttcgcccctttctcgcgtaaggttaaacgctgatgtacaccaaagcggtgctgttcatcaataatcacaagagcaagatgatgaaattccacctgatcttgaaacagggcgtgcgtgccgataatcatctgaacatcgccgtttttaatcgcttccaactgcgccgttctcgctttacctttcaccttgccggctaaccagcctacctcaatcccaaaaggtcgcagccagttggcaaaattatgggcgtgttgctcggcgagaatttcggtcggtgccattaacgccacctgtttaccattgtcaatcgccagcagtgccgccaatgctgccacaagggttttgcctgaacccacatcgccttgcaccagtcgcatcatcgggaaaggtttcgccaaatcctgttcaatctctgcggttacacgactttgggcgttagtcggctgaaacggcaaagtcgccaaaaagcgttgttttaaatcggtttgataacatagcggttcagcaaagtgttgttgcacgcccattcgcacctgttgcattgccaaattatgtgccaacaactcttcaaaaatcagtcgtttttgtgcagggtgttcacctttatctaacaattcggacgacacactcggcggcggtcgatgcaacaactgtaaggcttcttttaagctatatttgtgtggattaaattcatcgggaagcaattctgccacttgcacacgctcaagtaacgctaaggcttgatcggttaatttacgcaaagaggcttgcttcaagccttcggttgtcgggtaaatcggtgttaatgtttctgccagctcaagcggttgatttccccgaataatttgatattcagggtgatgcatttctgccataaagcgaccacgtttaatctcaccaaaggctttgacccttacgccagtcgccagactatttttcattcccgcattgaaattaaagaatttcagggtaattttgctcgtgccgtcagaaatcgtggtacttaaaatcgggcgacgaccgaattgtacttccgtcagttgcacaaagccttcaaccgtcgcaaaactttcaggacgaacatcggcaatcggcgtgatccgagtacggtcttcataccgtagcggcaaatggaatagcagatcttgcacgttattaatgccgatccgactgagtttctctgaaatcgccgccccaacacccgaaagggcggttagcggtacaccgtctaatagttgttggttcattgcaaaatggttgtggaaaataaccgcttgattgtatgctacatagagagggctaaagtagcccttagggacaaaaaataaagatagtccctagtatgaatagagaaagaaattattctttatccatcaacactacccaaccactatctaaccaatcacaaagtgtatcgagtaagagttctaattcatcttgattttcggccttagaagcaagtttattccacgaaatagcgtcaccattggcaatacggattaacaaattagcctcggcctcattgagttcatcaatccactcaccattgacataaacgcgtaacgggttctcagtataaaggactttaacattcgcatcttgttgcacccaaccacccgcttctagcacctcctgtacttcatcaggataaaactcgttgtcttcggttaattgttcataacgacgcgtactcacggcagtagcaacactatgcgtaaagatttcatcaaactgagtagagttttgcaataagtcgatcaaacgtgcttttaatgtagcaaccatttttggatcaagtaaggcgttcggttgcatatttggcgacaaacggaatgggattgcaaattgtgaatttgggataatttccccttgatgttcaatggttttacataggttttcaagtaaatctgtagcattagggaaacgtaaaccaaaagagaaagttaagcagtcatcttgtgctacgccataatgagaaaggcgtgacggtacataaagtacatcacctggtgcaagcacctcatcaaaaatcaattcgcccatatcatcaaaaatacggataggttggtttggtttaaattcagtgctagggtcgcaccatttgcctaactgccaacgacgatgcccatagccttgcacaaggaaaacatcatattcatcatagtgtttgccaacagaaccgccagcaggagcgtaagaaaccataatatcatcacgttgccattgtgggatatagccaaatgcttgccataatgcaccaagttctggcgaccactgttcaagattttgcactaatacagaccactgctcaggtaaattttcaaaatcttcagccgataacggactacgcttgagcgaccatttctcaccttctgctgtttgatgtgtttggatcaaacgagaagttacttccccttcctgagctaattcaataatgtcttgaggctcaaacagccccacaatttgtggtaatccattacgaattaaaagcggtcgtttttgccaataattttgcaaaaagtcttcagcagaaatattttcaggtaagcagaacgggatattcatagtcagctccttatatcgcaatctaaagtagcattttaacaacctatggcaagatttccaaacaactctatgcgattattcacaagttttagttccttggcattttgtagatatttcatctaacaactccctgatttttttccagatataattgctatccatttgtttaatctggttatagatagattgttctagaatgtattctgatgagtgtagagtatctcttatgatatattgctcataaatttcgggctgtaattcaaagtgaacaccagagagcaagaatttacctttaccataagatccacaaacaatggctgggcgatttgcagaatagcaagcaaccacagtctctgcatcctctgcttcactcaaaaacattggacctccatgataataaaagctcaattgagtgttattttgaaaagttaatgttgcaaaggtttttgatacagctgttccatcatagtagtactgattagtcaaatccggcaatgaaccaacagctttcccgttaaaaagcgctaattccctgttctcaaaaatttgataaccatctccagtaaattcgatggtctttgttgcataataagcaccggcacaaattccaagataaaaaccaccatgttgtacaaactgccgaatatgttggttcccttttccctttaattttgcacaataaggaagatcagcgccgcctggcataatcaacatttgacaatgttctagctcattatcaataatgtgctgtgcagtaatagtttttgtgggtaaaccaagatttgtagcaattgcaagttgcaaagatgctacccctacatcactcaccccatcatctacataaatacaaactggttttaccatcttacttattgccctaaaacagttactttttagtgtaagtctagtataatctgaacccattttccaatttaaaggaagtaactatgtttataacacaactttctcagactaaaaaatggttagaggcaaaccaatctctttcttttattttgaaatctcttattggtgcaaatcttattgcggtttttgctcaaatttctgtgccaatgtatcccgttccaattacaggtcagacgctagcattaaccgtagttggttttgcattggggcgtaaagctgctgtttctgcagtattactttatttatttgaaggtgtgattggtttaccagtatttgctaatggtggatctggatttcaatcattattaggcccatcaggtggatatttaattggttttgtaccgacagcttatttattaggatactttagtgataaaggtattttaaaatctttctggaaaagtgttgtggtagcattagctgcgactgttattactttcgtttttggactagctcaactttcactttttgtaccaagcgataaagtgcttgaattcggtttatatccattcattattggtggagttattaaggctgtacttgctagtttgttggttattccgtcctataaattcttttcaaaattatgattgcttaacggctctgcaaggtcagcttaatatttctagttaagcacaatagacaaaagagttcgtgttaattgttttctttattaccacaaactctttttgtttacattcgttaaacactctcagcaagttaaatcacccctaacttttctaaagccaacaaaatgccatcttgttcaatcggcaaagtgacataatctgccacagctttcagttcatcttccgcattgcccattgcaaccccaaagcctacggtagcaatcatttccaaatcatttaaaccatcaccaaacgccatcgcattttcaataccgaaaccaaaatggttgagaacatcttcaataccgcgtgcttttgagttatttttatttaacaaatccaccgaatatttatgccaacgcacttcttttaaatcatcttctaaaattccagagcgaataacctcttccgtgcgttcttgtggaaaaaacaccaatagttgaataaccgagtgatccaaataaaaattcggatcgacaatataatcttctttaattgggcgcaacgactcttccacttctgctgtatttttagatgcagcaatttgttctgctgtcacaaaggcatactcaatctgcaacgcctgcagtttggctaatatacgctcaatacgttcagttgttagcggatattcactgataacctgatctcgataaaggttatattgtccgtttgtcgtcacaaacagatcaaaacctttttcattcattaacggcttgattgctttaggaaaagccccgtaagttctgcccgtggcaatcgcagggataatccctttagctcgtaaacgaggaagtacttgctctgaaatagacagcggaatacgggtttcttttttgtaatataaggtttcatcaatatcaaaaaacacaattttgattggggcagttggcttttgcataacatctccttttatgtttaatctgtgaaattttactcttttttcgatccgcatcacaaaaattccccaaacttctcttaaaaaacttgatagagttcaaagaaaaaagttattgaggaaaagatgaacgactggggatttcgctgtatacattgcgacagacggcttgccattgcatcacacggtatttgtagccgttgtaatgatctgctaaaacgccactgctactgtggtggctgtggaagttttctgctaagcgatcacaattactgtggaaattgtttaaagaatgaacctaaatggcatcgcatcgtgcaaatttcccaatataaaccaccgcttgcagaatggatccaccgtttcaaatttcaacagcaatattggcttgatcaaccgttagcacgactgttactacttgctatttatcaagctagacgaacacatcagctcacattacccgaagtgattttgcccgtgccgttatattggcaacgggaatggcaacgagactacaatcaagcggtgcttttagcccaacagttagcaaaatggcttcatctgccaatggataaagagagtttacaacgtattcgagccacccaaccgcaacgagagctgacaggtcaagaacgtcgtaaaaatctacgaggggcttttatttatcaaccgaaacagccttatcaacgagtggcgattgtagatgatgtggttacgactggctcaaccttaaatgccatctgtgctgaattactcaaacagggggtaaaggaaattcaggtgtggacgttagcgagagcctaaccaaaataacctttcacttgtctgccaaatagtttcggcaatctgctcaggcgtttcacggcgtaattcgcataatgcgttgaaactgacaactaaacgctctggacggttcggctcgccttgataaccaaagacaggcatatcaggggcatcggtttcaagtaacaaactttccaaaggcaatttacgcattgtttctctggttttatttgctctttgatagcttatcgtaccgcccaccccgattttataacctaaatcaacaaaacgcttcgcttgttcataacttcctgcaaacccgtgtacaacacctgttcgagcaagttgtgcttttttcaaaaaagtaaaaagctgatcgtggcttttgcgagagtgtaaattcacaggcaaatcataccgcttggcaaaagctaattgtgcttctaaaaatgcacattgtttatgccacagctcaggcgtacaaactgcttcaactgctcgctctaagccaatctcggcaattgccgtgcaatgcggatcttggcgttgcagatagttttcaagtaaatccaaatcggctgtttgatgtccggcaatataaagggggtgtaagcctaagccatacacaatatggtttggttcagcttggctacaagcggcgacttgctcaaaattttttgcagaaattgctacaaccaaaattcgttccacctgttgcactttagcattatgtattaattgcgaaacagagagattgagatcttgagcgagatagtctagatgtgtgtgagtgtcgaaaaaacgcatattcaccctcgctcaatacttacttttactcgattttttatttatggacttggttctcgcattttttatcttaacttccttgaacactggcttttccgctttcgcttttttcttcgccgttttgccttcaccacgagctttgcgtaagctggtcattaaaacaaaatcaatttttttatcatcaagatttaccccgatcactttaactctaacaggatcgcccaagcggtacattacgccgttttcgccgacaagacgctggcggtcgctgtcgaaatggtaatagccgttatctaaggttgaaatgtggactaaaccgtcgatcagcagttcgttgagttttacgaacaagccaaaacccgttacgctggaaatcacaccatcaaacacttcgccgatatgatcttgcatatattcacatttcagccaatcagcaacttctcgtgtagcttcatctgctcgacgttccgttgcagaacatttttcaccgaaaatatccatatcgtcgatctgatagtgatagccaccgccatcggtatagtgacgcttgttgcctttttccttttcaatcaaatacttaatagcacgatgtaataacaaatcaggataacggcggatcggagaagtgaaatgggcatattccgtcaatgccaagccaaaatgtccttcattatcaggggaatagaccgcttgtttgagtgagcgaagtaacattgtctgaattaattcggcatcagggcgttctttgacctgttccagcaattcggcgtaatctttaggcgttggacgcaaaccgccatttaagcataaaccgcactctttcaagaaagtacggaaactggtgagcttttcttcactcggttgagcgtgaatacggaataaggctgcttcatttgcttcttccacaaaacgagcagaagcaatgttggctaaaatcatacactcttcaatgattttatgtgcatcattgcggatcacaggctcaatccgttcaattcgcccttgcggattgaaaataaattgattttcgaccgtttcaaactcaatcgcaccacgttggtgacgagtattcagcaacaccttatacattgcgtgcaactcttccaaatgtggcacaagatagaaataacgctcacgaagtgcttcgtcgccttctaaaatgttccacactttcgtataagttaagcgagcgtgcgagttcattaccgcttcatagaatttatagcccagtaacttaccgctttcagacaccgccatttctgccactaagcagagccgatctacttgcggatttaatgaacataacccatttgatagcacttcaggtaacatcgggatcacacgattagggaaatagaccgaattaccacgctgttgagcttcaagatcaagggcagttttcgggcgaacatagtaactcacatctgcaatcgccacccacaaacgccagccgttgctctctttttgacaaaacaccgcatcatcaaaatccctcgcactttcgccatcaatcgtcaccaacggtaagtcacgcagatcgacccgacctatttttgcttcgtcaggcacttcttcgttaaattgacgcacctgtttttccacaccttctggccaaacgtgcggaatatcgtggttacgcagagcaatttcgatttccatacctggtgcaagattatcccctagaatttccgtaatcacaccaacagggcgtttgaaatctgctttgcgtggctgaagttcaaccacaaccacttgccccattctcgcccctagacgatgttcttcagggatcaaaatatcctgattgatacgactatcatcaggcaccacataattgataccgctctcagtgaaaaaacgtccaacaatctgctttttgcgtgcttcaagcacacgtacaatccgtacttctttacgcccacgacggtcaattccattcggttgagccagcacaaaatcaccgtgcatcacacggatcatctgactattcgggataaaccagtcatcatcgccttcaacttgcaaaaagccgtagccatcacggtgtccaatcaccgtgcctttgattaagtccattttttcaggtaaggcataacgttttttcttagtaaagactaactgcccatcattttccatcgcacgcaaacgacgacgcaccgcttcttgacgttcttcatcataaagatgaaacgcttcaagcaactcttctctgctcatcggagcgtcatagtcacgaatggtttgtaaaataaattccctgctcggcacagggttctcatatttctcgagttctttttggtaatttggatcaacgatcattctattgttctctttataaaattatataacttattgtttttattattgaaatgtaaattcagaagtaggttcggttgggaaatgaatttagatcagataatttgactggggggattttaacacagagaagaggttttgtacgaaaaagatctctgttcttctttttataataaaaacaaagggttaattctttataaaaataacaaaaatttgatctagttaaaacctaccacttccatcttcaaattcaactagatagaatttatcctgttttattattacttaacgaggtttgtatgctctattttgagtttttactattattagcgtttctctatgtaggtagccgttttggcggtatcggtctaggggttgtttcgggaattggtttagccgttgaagtatttattttacgtatgccaccaggtaaggcacctgtggacgtcatgttaattatcttagctgttgtaacctgtgcatctattttagaagcggctggcggtttaaaatatatgctccaaattgcagaacgtattctgcgtaaaaatccaaaacgtgtcacacttttaggtccaattgttacctatatcatgacatttatgcttggaactggacactctgtatattcagtaatgccaattattgcagatattgcattaaaaaataaaatccgacctgagcgtccaatggctgcggcctctgttgcatcgcaattagctattacatcaagcccactttctgcagcagtagtattctatcttgcacggattacagaattaccagggcttgaaaatgtaaccttacttaatatcatctctgtaacagttccagctacttttgcaggtacaattgccttatcactatatagcttacgtcgtggtaaagagttggaagatgatccagaatatcaacgccgtttacaagatccaatctggcgtgaacgtattctaagtacaacaagtacaactttaaatgatgtattgccagctggtgctaaaaccgcagtattgttattcttactttcactaatcaccattgttgtaatcgcaatgttccctgaaattcgtactgtggcaacaggtgagaaagcaaaaccaatttcaatgtcacttatcattcaaatgatgatgctctgctttggtggtattattcttcttgcaacaagaactaatccacaaactgtgccaaatggtgtggtgtttaaatcaggtatggttgcagcgattgctatctttggtattgcgtggatgagtgatacttacttccaatatgcaatgccacaatttaaagcaggtattactgaaatggtagaaacctacccttggacttttgcattagctcttttcgcagtatctgtggtgattaatagccaagcagcaaccgcagtgatgatgttacctgttggtatcggcttaggtttgcctgctccattattagtcggtttaatgccagcaacttacgcttacttcttcattcctaactatccgtcagatattgcgacagtaaacttcgatgtaacaggtacaacgaagatcggtaaattctacttcaaccatagttttatggttccaggattaattggtgtacttgtcgcttgttgtgtaggcgtggcaattgcgaatgtagttatttaatcctacataatgtgagaagtcgtgcggaatatatgcattatatattccgcctatttttatcaaaaaacataaattcatcggttctcttttaatctattttggccagaaaaatctacaagtatttgagaaataaattatttaatccataaaaacttcaagatcttgatcattttttcgggtatgataacgatcttctcaaccctattaatttggagcaaactgtgtcttccctttggtctgattgtttaactcacttacaagcaaaagtatcgccaactgattacagcacttggctacgtccgttgcaagcgagtgcaactagctctgaattagtgttgtacgcacataatcagtttgtggcaacttgggtgaaagataaatttttaggggagattgttacccttgctcgatctttaagcaaaaatgagcagttgcaagtggagatgcgagtagggatcaaaccagcagaacaagcggtgacttctgttacaccaactgcaacgccaccgcaagaaacgcaagctactgcattacgttctggacttactgaaacgctcacctttgataactttgttcaagggaagtctaaccaactcgctaaagccgttgctcaacaggttgcaagtaaccctggtgaaagccactgcaatccattttcattatatggcggaacaggtcttggtaaaacgcacttgttgcacgcaatcggtaatgaaattttaaagcaaaacccgaatgcgagagtggtttatattcactcagagcgttttgtgcaggatatggtcaaagcgattaaagcgaacaccattgagaatttcaaaaaattctatcgctctcttgatgtgttgatgattgacgatattcagttttttgcgaacaaagaggcaacgcaagaggaatttttccatacatttaactcgttatttgaacgaagcaagcagattattgtaacgtccgatgtatttccgaaaaacattgaaaatatagaagaacgtatccgctctcgtttaagttggggagtaaatgcggcgattgagccgccagagttggaaactcgtgtggcaattttaatgaaaaaagcggaagaacgaggcattgagttaagtgaagatgtcgcctttttccttgggcaaaaactcagaactaacgtgcgcgaattagaaggggcgttaaatcgtgcaattgcgtggagcaatttcaccagccgtcagatcacaattgatgcggtacgagaagccttaaaagatctgattgcctcttacgatcacttaattaccattgagaatattcagaaaaccgtcgctgagtattacaatatcaaaatggcggatttaaaatcaaaaagtcgtacgcgttccgtggctcgtccacgccaaatggcaatggcattagcaaaagagctgactaaccacagtttgcctgaaatcggacgtgaatttggcggacgtgatcacacaacggtgatgcacgcctgcaaaaccattaatgagctaagagatactgataacagtatccaagaagattacaccaatttaacacgcaaattatcgtcttaaggaattgttatgcaatttactattacccgtgagcagttactcaagccgttacaacaggtttgtggcgtattaaccagtcgtccaacattacctgtaatcaacaacattttgctagaaattgaaggaagccgtttatctttaacgggaactgatttagaggtagagcttactacccaagcggagctgtttgaagcggtcagtttctcaggaaaatttactattcctgcgaaaaagtttttagatatttgtcgtagcttacctgatgatagcgtaatttcggtgcagtttgatgaagatcgtgtctttatccgtgcagatcgcagtaagttcaatctggcgaccttacctgcttcggattatccaagtttaatggactggaaacctgaagtcgatttcacaattgaacaagcgactttagcacgtttaattgaagcaactcaattttcaatggcaaaccaagatgcccgttatttcttaaacggtatgaagtttgaaactgaaggcaacttattgcgttcagtagcaacggacggacaccgccttgcagtctgcacaatggcattaaatcaagagcttttaacccattctgtgattgtgccacgcaaagcagtgttagagttagtccgcttggtgggacataataacgaaagcgttcgcttagaaatcggtacaagcaacctgcgtgtatcaatgaacggcattgtgtttacatcaaaactgattgatggacgtttccctgattaccgccgagtgttgccacgcaatgcagatcgtattttagaggcagatgcagaggtgttaaaacgtgctttggtgcgtgcggcgattttgtcaaacgaacgtttccgtggcgtgcgtttagccttaaatcaaaatctgttaaaaattacggcaaataacccagagcaagaagaagcggaagagatcattgatgtctcttatcaaagtgcagagatggaagtgggctttaatgtgagctatttgttagatgtgctgaatacattaaaatgccagcgtgtacgtattagccttgtagatgcaagttcaagctgcttaattgaagattgcgataatgctacggcggaatatgtgattatgccgatgagattgtaacttcagatgtagttatatttggagaaataaaatggaatacttagccccatttattcaaattgtggttggcttttttagctttatgttagtgttgcgaacttggctacagttctgtcgagttgatccttatatgccgatttcacaaacgttaatgcgtttaaccaaccctgtgttaaacccgctaagcaagctgatcccaacggtaaaaggaattaattttgctgcgttgcttttagctgcagggattgttgcattacaatttgtgttatttggtgttgatgtaccaagagctgtgcttatcggcttattaagtatcatcaaaatctttgggcaaattctcttttttaccaccttaattcgagccttaatgagttgggtgacacagggaaatcacccgttagattataccgttgcccaaattactgagcctgtactcggtattatccgtaaaattttaccgaaaacgggaatgttagacttctctgtaatggtgcttggttttgcgttgctctttattaatagcttgttctaccaaatctttggacaactatgggctgtggcgtaatgcaagcggtcgaattttgtgaaaatccgcaaggtatccgcttgcggatttttttacaaccgaaagcaagtcgagatcagattgtcggtttacacgataacgaactcaaaattgctattaccgctccccctattgatgggcaggcaaatgctcacttgctgaaatatctaagtaagttatttaaagtcccgaaaagcagtatcgtgttagaaaagggtgaactacaacgccataagcaaatttttgtgcctgaaccgaagctcattccaaaagagattgaagtattaggttaaacactgaaaaatttctatttttccatagcaaaacggcgataaaactgctaatttacacctattgaaaaccattcttaattgagagagaaattgaaatgttatttgcggtattgaccattgtggcttatttaggtgctttattatggattatgccaacacttgctcatcttgatacggataaacaaccgaatatccgtgcagtattgcttttgggcttagctgctgtactttgccatattattagcatttctcaacatctggttgtcaatggtggacaaaattttaccattgtaaatgttgcatctctgatcagtgtgattattagtgctgtggcgactttcgctttaactcgatggaaaacggtgtggtttccattgtctgtgatttatccgcttggtattgttactgtcaccttatctacctttgtcgcaggcagttttattaaacagctgtccgaaaatctagggttaatgctccatttaggcattgccattgcttcttatgcgttattttttatcgctctactttatgcggctcaacttaaatggttagataaaaatcttaaaagtaagaaaatggcattttctcccgtcgtacctccgttaatgaccgtcgaacgtcacttttttaccttaacaatggtggctcaaggattgctcacagtcgcccttgtcacaggaatgatctacttacacaacttctttgcaccagagcatattcataaggcgattttttctttcattgcgtggattgtgtataacatcttattattggggcaatggaaactccgctggcgaggaaatcgggtgctaatttattcaatttcaggtatgatactgctttcggttgcctattttggcagtcgaatggtgtaataccactaaggtagcggttagatttgttctctgtgttgcaaatttttttattcatctaaccgcttgtgactaacgaacataggacttttattttggacacgatccccctgagtagtttattcatcacactagctattcttctattgctttctgcattcttctctggctctgaaacagggctaatgtcgttaaaccgctaccgtatgcgccaccttgctgataaagggcataaaggggcaaaacttgctgaaaaactgttatcgagaacagatgttttattaagtctaattttaatctgtaataaccttgtcaatattgccgcttccgcaattgcaacgatgattggtatgcaattatccggtgaagcaggtgtggcgattgcaacgggattgctcacttttgtaatgctggtcttttctgaaatcttacctaaaacgattgcggctctttatcctgagcgagtgggttttttagtcagttatgttttagttccactgcaaaaagtcctaatgccagtggtcttttttatgaatatgattattaatggcttgatgaaattattccgtatccgcaagtctgaaaaatcagggttaagtgcagaagaactacgaggtgtcgtacttgaggcagggaaatttatccctaccgctcaccaagagatgttggtatcaattcttgatatggaaaaagtgactgttgatgacattatggtgcctcgcaatgatattggtagcattgacattgacgatgattggaaatccattatgcgtcagctcacaggggcagcgcacgctcacgttgtgatttataaaagcgatatggataaaaacctactcggtatgttgcgtgttcgagaggcgtttcgcttaatgttagagcgtaatgaatttaccaaagagcaacttatccgtgcagtagatgaaatctactttattccagaaggaacgccattaaatacacaattgatgaatttcaaaaataacaaaaaacgtatcggtttagtggttgatgaatatggtgatattaaagggttgattacacttgaagatattttagaagaaatcgtgggggaatttactacttcaactgcaccatcattggaagaagaagtgaagccacaatcagatggctctgtactgatcgaaggctcagctaatttacgcgacttaaataaactctttgattggaatttgccattagatgaagccagaacctttaatggattaattttagagcatcttgaaaaaatccctgacgaagatacgcaatttaccttgcttaatttaaaggtcacggtacttgaagtatctgataatatggtgaagttggcgagggttgagccgatttcaaaataacacaactttcccttgaggttttatttggttaatattatgtgacaattaagttctacataatactaacaaacatagtatacaaaactattggtggatactggcttaaaacctcgtactataccgcttttaatatccaatagttatgcatttccaaacaataaagaaactcctttaaataaaactaatttaattcaagttggggatccgaatgatttttatcaaattagacaggtagagcttgcaactttaacaaaaataactacaatacgcgctcttttcaagacatcttatctaatgccgacttagctcagtaggtagagcaactgacttgtaatcagtaggtcaccagttcgattccggtagtcggcaccatttttctctattcaatcacactacctcttcctaaacattccgcccagcgcacctaaaccaccaagacctccgcccatcatacctttcattccacgcatcatttttgccataccgcctttacgcatttttttcatcatacgttgcatttcgtcaaactgtttgagcagtttattcacatcttgcacttgcgtacctgagcctaacgcaatacggcgacggcgtgaacctttgataatgtcagggttagcacgctctttcagggtcattgaattgatgatcgcttccattttgatgaacattttgtcatcgacttgatttttaacgtgatccggtaaattcttcgccccaggtaatttatcaagcatcgacatcataccgcccatttttttcatttccaccaactgttcacggaaatcatcaagggtaaaatcatcgcctttcttgaatttcgccgccattttttcggctttttcctgatctacagaacgttgtaagtcttcaatcaacgatagcacatcgcccatacctaaaatacgtgaagcgatacgatcagggtggaacggctcaagggcatcggttttctcgccaacccctaagaatttaatcggcttgcctgtaatttgacgaatagataacgccgcaccaccacgagcatcaccatcgactttggttaaaatcacccctgtaagcggcaaggcttcattaaaggcttttgccgtgtttgccgcatcttgacctgtcattgcatcgacagtaaacaaggtttcaattgggtttaacaccgagtgaatttgctggatctcttccatcatctcgccatcaacgtgcaagcgacctgcggtatcgacaattaacacatcaaagaaattgagtttggcgtgtttcaatgctgcttcggcaatgtctaccggtttttgcgacgtttctgtcgggaagaaatcaacttttaacgcttcagccaacgtttgaagctgtttaatcgccgctggacgataaacgtcagcagacaccacaagcacttttttcttatggcgttcttttaagaatttcgccaatttaccaacagaggtcgttttacctgccccctgcaaaccagccattaaaattaccgctggcggttgggtggcaaggttcagcccttcatttgcttcgcccatcgctttttcaagctcagcttgcacgatttttaggaactcttgccctggtgttaagcttttattgacttcttcgccaatagcacgctctttgactttattgataaactcacgcaccacaggcaaagccacatcggcttctaacaacgccatacgcacttcacgcagggtatctttaatgttatcttcggttaaacgccctttccccgtaatgtttttcagggttttagacagtctgtcggataggttctcaaacataatcttttctctatttgcaaaatttagttcaatttgaccgcttgtatccccccttccgccttcggcaccttcccccgcttgtgggggaagggaagtcagggatgaaatgttggcattatacaaaaaaagaacgaaagagggggattagatcacagaaagttatacattcatcagaaaactcaaaatctttttaaagaacttcgatgttgaattttcgtttgtaccagttcccctctttgagcttcgagaggttaggggagatttggcagaatatacaacttctctttccttgatgtaaaactgctttattctttataacaattcttctagaataagtcgatttttttacaatatgagtatgctatgtcgaaatctatttgtatcatcaccggtagcaccttaggcggtgcggagtatgtcgccgatcatctcaatgatgttctcactgaacaaggctatcaggttggactgtttaaccaagccgaattagccgatattcaacatcaaactgccctgttagtcgtcacatcaacacacggtgcaggagaactgcctgaaaatatccaaccccttttccaacaacttgccgaaagcaatcttgatctcagccagatgaaatttggggttgtcggattaggcagttccgattacgacactttctgcaatgccgtcaatcttgttgaacaaggcttaactgccaaaggggcgacacaagtatgcgaatctctacgcattgacgtggtgaataattttgaccacgatggaagtgcggaagaatggcttccagcttttacttcaaccttataacaaggactaaactatgaaaaagctactaggtactctctttatgttatcagtgagcatataaaatttaaggcatagtagacaaaagcgttggtaaaaagtgggctaaagccttatagcacaaggctttaagcccactttttgaaatataaacaaaaaactgtcctttttgccttaagaacaatatccaaaagtatcactgttccattagaactattcaacgttatattgaaaaatcccccaaagctaaattaattcctttacaacaaacctatctcaatattatttcagacgtgaccttctttggtcgtgaatttggtgtattagttttaatagataccttatctaaatcaccgctttcattagatttccgcctattatttctagcttttattgataaaagttgaaaaatccttgttattttattcttagttttgtgcaacgcattgttttttttttttttttacaatggggcggcggaagtagcttgtagggtgggtcttgacccaccatgtagccgtaacatattgattttattggtgggttaaaacccaccctacaatattcaatccatctaatatatggtttgtcaaggagttaacttcccccgcttgcgggggaagtagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtgcatcctgaaaatgtaaataaaggtttacgatgctttattaggaaaagcggtagagaagattattatgaataaaatatttagagttatttggagtcatgctcaacaggcttgggtagttgtatctgagttagtaaagtctcataccaaaacatccgcttacacggataaaagagctcaagtatgcacctcagattattttttagataaacagcaagataaatttaaattaagtcttttaagtctagtattactaggtatattttttagtccagtaggtttagctgcatggtttgaagatggtgctactgcatcggatagtggatctgacgacggtactattggtattggtcaagggagtaaggcttcgtatggtgctattgccttcggtcagtattcaaaagctgaagctaggcataatattgcgataggttatggagcagattcaggaacacaagtaaactctcttgcgataggctaccgcactacagtaagaggggctggagcaattgccttaggcaaagaagccaattcgacaaatagtcaaacaattgccatcgggagtgattcaaaagcgagcggagatgaatctattgccttaggcggacaagccaattcgacaaataatcaaacaattgccatcgggagtcagtcaaaagcgagcggagaacaatctattgtcttaggcacaggggccagtgtgacaggtactcaaacaattgtaataggcgcacgtgctagtgcaagtgggcaccaatctgttgctatcggggcaaatacccaagcgaatgggtatggctccatatcaatcggtggagatgatttagctacaacgaaatatcaagctaatgatcgagtctattcccaaacaacaattgcgagaggtgatgcctctgttgctattgggggtcgatcttcggctagtggcgctggatctattgttgtaggtcctttagcatctgcaactcatgctgaaggcattgctatcggtgcgagaagtaggtctaacaatgagtacggtattgcggttggtagtggtgcacatgctggaaaacactccattgctgttggtaaaagtgctactgcaagtccaagaggagcttccgcattcggtgaagaggcacgagcaatcggacagtatacaacagcattggggagttatgcggaagcagaaacgcaagatggcgttgctctaggttatcgatccaaaactagtcgtcagtcagggcaagcaggttggaaaccagataatacaaattattctattagcggaagtacattatctgctacgcatgcagcggtagcagtaggtgatggcaccaccgtcactcgtcaaattaccagtgttgctgcagggacagcagatactgacgcagcaaacgtggcgcaattaaaagcactgactttaaagatcagtggcgatagaaatacgcagggtcacacaacattttataacgaaacgctctcaattgtaggggctgatggtattagtacggcagttgagcagagaaatggcaattcaaaaattaccattactggctcaaaaacgtattttcatactaactataacgatcagtctcaaggtcggggagatcctacgactaatttcggcacaattactgacaaagctggagctacaggaacctatgcaataacagcgggggtaaatgcctctgcgactggaaattatggtattgcgatggggtataagagtaatgctagtgcttatgctgttgctcttggtagtgaatcgaaaggtgctggggcagattccattgcgataggtaatcttgcgagaacaacaggggtagactctgttgttgtgggtgcccatatcaatgtgacaggtcaaaaatcagtggcagttggacgccaagcaaatgctagagattattctactgccttgggttataaagcctctgccaatggtacgtactctgttgctgtgggtgaagaagccatgataaatgtaaatgctgctagagcaaccgcacttggtcataataccgttgtcaccgtgggtggcggtgtggcattaggttatggatctaatgcaagtatagctggcggtgtagtggggttaaaacaagctcattctgtcacaacgggaacaagcactgaagctaacggctttaaatccacacaaaaggttgatggtaataatattggtgcagtttctgtgggtggtacaaccatcaaacgccaaatcgtcaatgtggcggctggtacacaagataccgatgcggtaaacgtggcacagcttaaatctttgacgatgaaaattggtggtgataccaatgctaatacacagccaaaagtggggttgtgggatggtattcttaaagtgctaggcacaaatggcgaaatcaagaccaatgcgtctggctcaaccattacaatatcactagacgatacgattaaaaataaattagctgatgccagagcaggaagtttgatattcaagggcgaaaaaacagataacggtacaacaaatgatgtttcgggtcaaaaatggaaggccaacgaagataaggccgttaccattgcaagtaacgaaacataccaaaacggtggtgttcgatacaaaggcgataacattgaaatttatcgtagaaatctagaattccatgtgttgatgaaagatgcaccaacattcagcagcgttcaatatggcgataatggacctaagattaccagcaccactgacggtaatctaaaagtaacaggtacagacagcacttccccagttaagatcaccaatttacaagcaggtacacaaaatggcgatgcggtgaactacatgcaattttcaaatgctggttggaaacttgcaattgctccgggagcgggtggtcaagcaaatccacctggggcacatcttatcaaaataaacgataccgtaacctttaccgctggaaataatattaaattagaacaaaataacggaaatattacgatttctacgattggtaagttaattaaagagactaaaaccttagataatggcgatctaaaaattacctatacagataatacggatagcatcatcaaaaaaggtgaaaaaggagatcgtggcgaacgaggtctaagaggtgaaacaggccctgcgggtccagcgggaccacgaggacctgcgggtcaagcaggggctaggggtgaaccgggtcctagaggtgagcgaggtattcaaggacctgcgggtgagcgaggccctgcaggtgtagctggacctaagggtgagaaaggtgatccaggaccaaaaggcgaagctggtccaacaggtccgaggggtccagtgggaccacaaggaccgcaaggaacaccgggtactcagggacagaagggggataaaggcgatccaggacctacgggtccagcagggcctaggggtgaacagggtcctgaaggtaaacaaggtattcaaggacctacgggtccagcaggaccacgaggccctgcgggtgagcgaggagaaacaggccctgcaggtgcagctggacctgcgggcccagcaggcccagcgggagagcgaggccctgcgggagagcgaggccctgcgggtgaacgaggagaaactggccctgcgggtcctagaggcgaacgagggcttccaggggtagcaggtcctaagggcgatagaggcgaagctggtcctgctggagcaacaggaccacgaggacctgcgggtccagcaggtccaattggaccacaaggtgcacctggtcctgcgggtccaaaaggagaggcaggagcaaaaggcgagaggggtgaccgtggtgaagcaggagcagtgggccctcaaggtcctagaggtgagcaaggtctaagaggtgaacgaggcccagcgggtcctagaggcgaaactggtttaacaggtcctagggggccagagggaccacaaggaccgcaaggaacaccgggtactccgggacagaagggggataaaggcgatccaggacctgcgggtccagtaggacctaggggtgaacagggtcaaaaaggagaaacaggccctgcgggtccagcaggaccacgaggccctgcaggtgtagctggacctgcgggtcctaaaggagatgcaggtccaaaaggagatacaggtcctagaggcgaagctggtcctgcgggtccagtaggtccaactggaccacgaggtgcacctggtcctgcgggtccagcaggggctaggggtccagagggtccgaaaggtgaaacaggagctcaaggtccgatgggtccggcaggcccagcgggagagcgaggcgagcagggtcctaggggggaacaaggtgcaactggccctgcgggtccagcagggcctaggggtgagcgaggccctgcaggtgaaactggaccacaaggtgtacctggcccagcgggagagcgaggtccagcgggagagcgaggacctgcgggtccagcaggggctaagggtgaacagggtccaaaaggtgatacaggtgagagaggtgcaactggccctgcgggtccagtaggtccagcggggccacgaggtgcacctggtcctgcaggtccaaaaggagaggcaggagcaaaaggcgataggggtgcccgtggtgaagcaggaccaatgggccctcaaggtcctagaggtgaaccgggtcctaaaggtgaaccaggtccaaaaggtgatacaggtgagagaggtgcaactggccctgcgggagagcgaggcgagcagggtcctaggggggaacaaggtgcaactggccctgcgggtccagcagggcctagaggtgagcgaggagaaactggccctgcgggtccagtaggtccagcgggaccacgaggtgcacctggtcctgcaggtccaaaaggagaggcaggagaaaaaggcgataggggtgaccgtggtgaagcaggagcagtgggccctcaaggtcctagaggtgagcaaggtctaagaggtgaacgaggcccagcgggtcctagaggcgaaactggtttaacaggtccgaggggtccagtgggaccgcaaggaacaccgggtactcagggacagaagggggataaaggcgatccaggacctacgggtccagcagggcctaggggtgaacagggtcctgaaggtaaacaaggtattcaaggacctacgggtccagcaggaccacgaggccctgcgggtgagcgaggagaaacaggccctgcaggtgcagctggacctgcgggcccagcaggcccagcgggagagcgaggccctgcgggagagcgaggccctgcgggagagcgaggccctgcgggtgaacgaggagaaactggccctgcgggtccagcaggggctaggggtgaacggggtcctagaggtgaaccaggtccaaaaggagatacaggttcaaaaggagatacaggtccagtgggtccaacgggaccacaaggaccgcagggaacagcaggtattcagggacctaagggtgagcgaggaaatgtgagtgtcagcggtttaccgatcgagtatgcaacggaagacggcaaatcaattatcaatatgggcggtaatttctatttggaagaacctgctaaagatggttcgattaagttaattccagtggtgaatgttaaaggtaaattctcaaccaaaacgcaaaatccagatggcagtattacgcttaagtcattagcagtaaaagtgaatttggcaaataaaactccgatggtattaggtaatgtcgctgaaggggtagcagatacggacgctgttaatgtgaaacagttgaaatctgcgaaaactgaagtggaatctaccgatcacagtgtggtgattaaagagcgtcagggcgataatcagcaaatcgtgtatgatttggcggttgctaaaacgaaactcactgcctctaaggataaacgcaccattagtgcagcagataaaggcaaccattttgcgacaggagatgaagtcgcagcagcaattaataccgcaacagcagccgcaagaactgaggttgaagcgggtaaaaatgtgaaagtgacttcaaaaacgggggcaaatggtcagaatatttacaatgtgagcgtgtttggagatttaagcgacattacttcaattagtaatggcgatacgaaagtatctttaggtaaagataagcaaggaaatccagttgtaaatatgaatggcgccagaattaccaacgttggagatggtagtgctgagggcgatattgtgaatgttcgtcagctcaacaaagtggtttcttctgtgaatacaggatttaatcaattatcaagagatattgttaatgcaagagcgggtattgcttctgctggggcgatggctaatttgccacaaatttctttaccaggtaaaagtgctatttctgtttctaatgcacaatatcgcgggcaatctgcctatgctataggttattccaaaatttctgataatggcaaatggcttattcgagcgtctgttagcagtaatactcagcgggatactatgattggaggaggggtaggttttgtgtggtaatctagcacctataattaggtatagtagacaaaagtgttgataaaaagtgggctaatttgtctactatgccaaatttaaggggctgacctagattagctagcatactaatctaggtcagccccattatttaatatctatctcaattgatctctttattggtatcatcaaaatattgattcatttcaaaagcgggtttttgttgttgagaatgcccaataattcgagcagggacaccagccgcagtggcatattcaggcaccgcttgtaatacaaccgaatttgccccaatttttgagtaacgaccaatctcaatattacctaaaattttagccccagccccaatcatcacgccttcacgaattttcgggtggcgatctccgtgttctttacctgtaccacctagcgttacaccttgcaaaatagacacatcgttttcgatcactgccgtttctcccaccacaatccccgtggcgtggtctaacataatgccacaaccaacactagccgcagggtgaatatccacatcaaaagcaacggaaatctcattttgcagataaatagccaaagcttttcgcccttgttgccacaaataatgggtgactctatagctttgcaaagcgtgataacctttgagataaagcaaaggcgtactccatttatcgaccgcaggatctcgagtacgaacagcttcaatatcgcaggcagcactggcaataatttgcggatctgcttgataggcttcttcaatgatctcttttaatgcaattgccggcataatcgcatttgccagtttgtttgccaaaatatagcttaacgcatcgcctaaatgatgatgtttcagaatggttgcgtgaaaaaaactggcaagcatcggctcactatttacaagctcttgtgcttcattacgaatattctgccaaataagatcaagcggttggtttgtcatctttattccccttttcgttcacgacctaaaagcgttttagcaacatcactggcgtgcttgccacagaacaaaatctgataaatttgttccacaatcggcatctcaatgccttgtttttgagccagtaaataggcttctttggtattataaaacccttcaacgacttgcccaatttcagccatcgcctcttgagcatttctcccttgtccaagcattaaaccaaaacggcggttgcgagattgattgtcggtacaggttagcaccaaatcaccaagccctgccatacctataaaggtggtgggatttgcccctaaagacagccctagacgactaatctctgctaatccccgtgtaattaatgcagtgcgagcatttgccccaaagcccattccatctgaaatccctgtaccaatcgcaatcacatttttaatcgccccaccgagctgtacgccaaccatatcactattcaaataaacccgaaaggcttttgagcaatgaatacgctgttgcatttcatcggcaaactgaggatcagtggaagaaagagcaatagcagtcggcaatccttgagctaactcttttgcaaaagtcggccctgaaagcaccgctagcggatagcgatcacctaaaatttgcaaagccacttcttgcaacaatcttcctgtgtctcgctctaaccctttggttgcccacataatacgatgttcagaagttaataacggttgaatttgttgtagaacttcagaaaaaacgtggctaggcacaacaattaaaatatctttcgagcgagttaatgccgttgcaagatcgctttcaatctctaatgcctctggaaatggaatatcgggtagaaattcttcactcatacgccgtacagccatttgagccattttctgcgaattatgtccccaaaggtatgttttatgcccattacgagaaagtgcaatcgccagtgcagtgccgtatgaaccggcaccgagtacggtaatgggggctgaatatattttttccataaaaatatcttaattatttataatatacttattaactaatttatatatgataatctctaaaagcgatatattacagttatcaataaatatttcacctaatgattcatggggataaaagaagtctttatgatttttaacgattttactcatttatggagtaaatttaataatgacgaagaatatcttaaggaaggtctaataatatgtaagactaactagccatgatgctaaaaatgtaataagactattcctattgaattatctctaagtttccataactattaaaatgtttatatattagacgtgtgaccgtatttttaatttttaatttttactaactaaaccaactccccacagaaccggtacccttcaccgtgaatagtcacgataatttctggggtatttgggtgatcttcaaagtgtttacggatacggcggatcgtcacatcaacggtacgatcgtgaggtttcaattcacgtcccttcatttgttttaacagatcttcacgggtctggattttccctggatttttacagaagtgaagtaaggctctaaactcactacgaggaagtttaattacctcattttcagggttaatcaaactgcgactatttacatctaaagtccagccattaaagcgataactttcggtattgtgtggatcttttaccgttttgtctttttccgccattgtgcgttgcaataagtttctggcacgaatagtgagttcacgaggattgaacggcttagtaatgtaatcatcagccccgatctctagccctaaaattttatccacttcgttatcacgtccagtcaaaaacattaatgcaatatcagtgttttctctgagttctcgagcaagcattaagccatttttgcctggtaaattgatatccataatcacaaggttaatttcgtgattatctaagatggtgttcatttcgttgccgtcagtggcttcaaatacatcatagccttcagcttcaaatatgctttttaatgtacttctcgtaacagcttcatcttcaacaataagaatttgtgggttttgcattagattaccttcagtttgtttgagttgccctgctactatgactgcgatagcgaacaaatgttgcaaagttgtagtattttatctctgttttttagcatcataaatacattattttacatttctttagcttcaatcaaaatctgctaagaaatattcgcgatgatcttaacattattgttaaagtttgacatattcaagcggtaagttaagtaagttttttaccaaactctcggtcattgctcgatggctgagtaccgcatatttttcagcaagaataacccttgaaattgtcacaccttctaaaccttgcattcgacggaaatttaaagcactttgtaacggcaagaaacttggattgaatgccgcattttctgcatagcgtcccgtgataatctgttcaccacactgtaatgctaccccactcaccgctttactataaggcgcatacgcaagatttgccgccgaaattgccgcttgttgtaacgcatcgccacttgcttcaaagccattttgttgaggatcgaataaaaccttgtcaatctgtaaatcttttggtccaaaagcatctggcaggtaactgtgtaataaattattttgactatgtggtaaatgaatttttagttgtttagcactattgagttcattcataaattggcgacagtgtccgcaaggagtgtagttcactaccatatcggttaatgcagtttcccctgcgatccaagcgtgtgaaacggcactttgctctgcgtgaacagtttgttgcatcgcatcgctctcaaattcttgatttgccccaaaatagaaattccctgatttgccaatcgccacagcccctacaaaaaaatgagaaacaggcactctggcgtagcaagccgcaataggtaagcattctaaagcaagttcgacaggggataggttgaatgtttgacaaaatgtggtgacttgttctgcagaaaagtatgctttattgttttgtcgaattaactgctccacaaccgcttgaacaacagggctttgtttttctgcaacaagttcgattaaacgttcttggatatcgatcattgtaggcatagaatgctcctttatgctaaaaattaggggcgaaaattataatgagaaatcaatgggataactgtgatctagatcgcatttagtaataatagtacgctttatcgttcaacaattacaccaacacttgaggattgagcaactgctttaggcttgtgtaattcaatgcgtaatgatttcaccccaaactcgtgttgcagtagttcggccactcgataagcaacggtttcaaccaacttaaacggtgtattttcaacaaaatcaaggatcttttgtgaaacttccgcataatttaagcagtactgtacatcatcatctgcgacagctcggctaaaatcccacgccatttcaatattgaaaactaaacgttgtttaatggtatgttcccactcataagccccaatagaggcaaaagcggtgagttcgtgaataaaaactttatcagtcatcggatctttccttgtttttctttttgaaagttaaggtaaaatatagcacaaagtaagcaacaaataaggggaaaaaatgagcgttattgcttatttactgattttaggggcatatttgcttggttctatttcaagtgccgtcattttttgtcgattagcaggactacccgatccacgagaacacggatcacataaccctggggcaacaaacgtcctacgcataggcggaaagttatcggcattaggtgttttaatggcggacatcttaaaaggtatgctacctgtttctcttggtttttatttagaactgccaatttcggtgattggctttattgctttggcagcttgtcttggacatattttccccgttttctttaagttccgaggtggcaaaggggttgcaactgcctttggagcaatcattccaatgggctattcagttgctggattagcggtgggaacgtggttgttcgtttttttgatttctggttattcatcgctaagtgcagttattacagcattgatcgttccactttatatttggtggtttagctctgaattaacattccctgtcgcattagtttgttgtctattagtctatcgccatcacgataatattcagcgtttgtggcgagggcaggaagataggggttggaagaaaaaacatagtagacaaaatggttactaaaagttgaattagcactatattacaaggaattaatctactttttgaaaactattttgtctattacactaccactgtacctattattatctattcaataccaccaaatgtcgctctccgactaactcaggtacgttcaatttaatcacgtccaccaactcaatcggtttgctcacttctgccaactcttctggctgatactgtccttttaacgcataaaagtgaccgcttgtattcggcaaatggtagcaccaatcaaccatatcatttagagatgcaaaagctcggcttaatacgccgtcaaattgttgctcttgatactcttcaacccgacttagcacaggagtgacattggtgagttttagctcacgaatggcatttttgataaaggtaatgcgtttgcctaagctatctaacaacacaaactgcttatctggattggctatcgccagcggaatacccggtaaaccaggtcctgttccaacatcaataaactgttgtccttgtaaatgttggcttactacaaggctatccataatatgcttaaccaacatttcatcgggattacgcacagaagtgagattatacgccttgttccatttatccaataatttgacgaaatcaaccaactgctgcttttgctgatcggtcaagggaatgtttgcttgactgagcaagcggtctaatttggctaacattttgtttatcctattttgtggttaattctgcgaatagttcatctaaccctgcaagggctgcttccaattcggcttttgcttccgcaatcagctcttctggctcaggcaaatcttcactgctaacagcggcattatctttaagccagctaatatctaaactatcgccttttacatctcgaatataagtgcgatcaaaacatttccaacgactattttccgctgtttgttccccttcggtatagctccactccccttcttggcgagcactcaaaatcatcgttatattcgctttattgacatcaagttcggtcggattaaataccttttcaaaggcttcaaggtatttttctgtaaacggagtacgcttaccaaagctcggcatatttgtacgtaaatcataaacccacgttttttgagttgaattttccgcatcgttactgactttgtcaaaaaacagcacattggttttcacaccctgagcataaaaaatccccgttggtaaacgcaaaatcgtatgcaaatgacatttatccattaaatctttgcgaatatccgtccctttaccggcttcaaacaaaacattatccggcaacaccaccgccgcacgtccaccttcttttaaattacgatagatatgctgcaagaaagccagctgtttattagtcgtttcaaaggttaaatcatcacgggttatcaccgcatcaccgcctttactggtgccaaatggcggattagcaaggataatatcagcaggttttaaatttttgcccacatcacctaagctgttaccttgaataaccgccccttctgaaccaccttcaataccgtgtaataaacagttcattaacgcaaggcgacgagtattggtcactaactccacccctttaaaggcttcgtgaatttgaaaatgacgatcttgttcgcttaaatcaaaataatcatcggttttgttgcgcatatattggtcggcagcaatcaaaaagccagctgttccagcggcaggatcttgaattacctctccaaccacggggttaatacaacgtaccatcgagttaatcaatgcacgtggcgtaaaatattgccctgcacctgatttcgtttcagtggcatttttttcaagcaatccctcatataaatcgcccaaaccatctttttgcgccgagaaccaatccatttcatcaaagttacgcactaattgctctaaatgctttggttgcgttaatgaggtttttgcattggcataaatcgctaacaataacgggttattatgaacgatctcatcattttctttacccgttgaaagcacaagcaacatacggcgatagttatctaaaagattgatacctgatttaccgcttaaatcttcccaacggcaaccttcgggtaataatggtttaaattctgttttctcttcaataaataattgctctttttcgtgcaccattttaataaacagcaacatcaccaattcggttaaatagtcgttgtagttaatgccatcatcacgtagcacatcacacaaattccaaagtttttggactatttcgttatttgtcataatcaaccttattttgaagaggctaaatcagaaaattttcttcttaaatttttccattcagaaagttgttcaaggtgtttaccttgccataaatcaagatgtttaatgcctatttcggctaatttatattcaaggttattgcacgctaaaaattgttctttaaattcttttattcccgtaccaaaaacatctttaattgtttggcaattagaacaacgaactatctcatcttcaagatttttagtttgctgtaataaaaagaactttattttttgttgttttagaacacggagatttcgagtaaaacgttctatattatgaataacatctgtatcataaataatataaatttcatcagctcttaatctcgctaagatagaagaaatatccttatcccataaattaataagctgcactttacctaacaaatttaaagctttaataaattctcgttctgtttgaccttctactaaaaattggatcgttgttctctttttcatccgcaagaccctataacaattcatctaataatgacgtatcaggaatagtataaaatacattattttgaacataattaagcaatgaacgatcatttttcttaaatttttgttctggttgaataaactctgctttatcgccagtcttatgtaagaaaacaaatgaatgtattggtagattcaaatctaaaacatcgtaattatgcgttgtataaataaattgagcataacgcatcattttttgtgaaattaaattcacaatcgcttgttcaatttcagaatgactatatgccattttttcatcaagaaaatagattgcacaaacagatttcaatgatttattttgttctgcattctgtaatataaaagcgataaaatcagcaacttgaattgcatcaaacgtcccttttgataaacgatctttattgggaatatcaccatttttatcaatcaatacactatccttattactaaaacgaatactatatccttcaagttcatcttgattacgtaattcattaactgaaacaattgagggatcaaacgttttaagtacggtttctaaaatacccgcatttaaatgtccatcttgaatagataattgacttttatctgtattatcagaaaacatataataaaaacataaattttctgctatcttttgacgaatattgtcaaataaaaaaataggattattatcttcagtttcataataattgccattcttaatatttgaatttccttttttagcaaaaaattccatcaaacgctttcttgctgatgtgctagtatctttatccaaaataggaattgaagcatatttaattaaaggatattctgattttcttgctattgactgtacaatttctaaataatgaatagtattattttcaggtagaacaaattctacttttatcaacccatttttctctttatcattgatttgttttaataaattactatttgggaacaaaataaaatgctgaatataacgcattattttaccgagtgatgttttaccactcgcattagccccagaaagaatacaaacccgcttaaaacgaaaattagggcgttcatcaagaaattctccatcaatagcactgtgtaagattttacgttttaacgtaaaatcaatcactgcatttgagaaattatagatattatcgataaaaagataggtaaacagcatataatttccaccttttggaagttaaattaactaaagtgtaccataaatccaattttttgcacgatttttacaactatccctgacatcctttatccaaaatggcttatgtcattaaatttacccgttccaaagcggcattaacttgagcttcaagctgatttacaaaatttaggtatttttcgactgcttagattaaatttttcttaacaattcaaacttaccccattttctcccacagcccctcatttaactctgccaataactcatctaatgtttcaccaaattcggctcgaataccactaaattgcccttggaatagctcggttaaacgactacgatctaaaatttcatcgtgattttgtttaagctgttttgcgatccgctctaaccatttttgttggttgggtttaaatgaatgtgcttggcacaatttttcaatcgcatgatcaacacgctgttcaaaaggaacaagactatcgccaatcgccgcacggcggatatgcgccacaataccggcggaaatgtgacggttcgttttttgccccattgctttattcagtttcgctttactaaacccctgtgcatctaaagcaagctcaatatctttaagctgctgacgagtaagattgcgagggcggttaataattacctgtatcgcaacactgtcgttactatgctgttgaatataggccataaattcttgcaaataatcgtccgcactttcgccctttccgtagattggggtaatttctcgcacttcatcttcgtgcgtagaaatcaccggcattcgttcgcttggtaacatagcttgcaagcggttaaattcggttaagatattgcgatgtttttcgaaaaattgtaccgccccttgaacgccaatcttaagtaaatgtttatgcaacaaattaggttttacaccccattcctgttcaagaatagcgagattttccttcatctgtgggcttttttctgccattttgtccgctttacgcagcaatcgcataattttttggctaatttgttcaagtaatgcctgctgatgttcattggctagtgggtttgcattattttcaatttttcctaccgcttgtaattcttccactaattgcgaaatgggttgatgaacgttcttcactatcggtttcatggtatccacacttgccattgctcggcataaacccactgcatcgtaaatatggaacacggttttccctaatgcctcacatttacgtgtcgctcgacctttcatctgttcataaagcacacgagattttacacggcgtaaaaagactaaattgcaaatctccggtacatcaatccccgtagaaagcaaatccaccgtaatggcgatattcgggtaacgttcgtttttaaaatatttgataagcgtattaggtttatccgcttgccccgtaattttcgccacggcattggtattatactcatcaccatatttttgtttgaataaggtatctaatatgcctttaatcttatcagcgtgtagatctgtcgcacagaaaatcaaggttttttcgctgccaaaaggatcaagataatccagtaaaacttcacaaaccacttgattaaaactgtcatttaataccgtgcgattaaaactctctacatcaaaattttgctcatcggcaagttcacttaataccacttcacctgtaccggtgtcgataaattctaactgctcgccacgctcaaaatgaataccatcttgattaagtttcgtcttaatctctatcggaggctcgtgatcgaccaaataatcatcaatcaccgcttctttgtaagaatagacaaaaacaggctcaccaaaaatttctttggtgtgtagagcaggggttgccgtcaaaccaatttttactgcatcaaaataatctaacactcggcgatacgtggataaatattgctcattatcttgaaattctaactcaccatctgtcatttcttgatcaagcgtatagccacgatgggcttcgtccacaataatacagtcaaattgatcaattgccggagcttcgcccgaataaaaaatctgttttaccaaagattgtaccgtcgccaccttcactttcgtttcaggttcaaccacaccattcaccgcaaagttatacaacgtatttaaggtttggttgggttccacgttcatcccaccaaaggtatcttccgcttgctccgccagtgcggttctatccaccaaaaaaagaattcggcgaaaacgatccgtttttaaaaagcggtgaattaatcctgtaattgtccgagttttccctgttcccgttgccattgccagcaacatttctcgtttaccctcactcaagttctgctctaccgcttggatagctttctcttgataaggtcgtagccccaagaaatcaaagggttcattttcgagtttttgcgttgcttgttcttcatctttttttaacatttccaataatacatctggtgtatgaaattgttgtaacgcacgcttaagattagacggctgacgaacatctctaaaccacgtccccgacagttctagctgttgcttaagataaggtttaccattacaggaatacacaaagggtacataaaaatgcaagccatcattggcactttcatctgaagcccaagcgacagtccgtttcgccaacacccaaggtgcggttaaattttctgtgatctcaaactgtttcgcataacgctccgcttgtgcaactttaccggcaacattcacattcgccttttttgcttccacaatggctacaggcactaacccacaaaaaagcacataatctgcacgatctttccccaccggatattcagcaatggcaagataacgtcctttttcagggcgaacaccttttcgataatccaaattttcactatcggcttcccagccggcttctcgcaacatagggtcaatcatcaaaagacgagtttgtttttcgtccaacaaacgtaattcataattcttcaaacgctcaaaggcttgtgctgcacgtttttcgcgcgccacatcaaaggcttgtttttcttcttcgctttggtttgaaagtgcggtggaaatggcttgaatttctgcttgattagcttcgactaattgctgttcttcctgttgcgaagcagtcggattttcggtgtattttgcaggattttcattgcttcttaccgcttgtaaataatccggacaaaacggtacaggctcaaaatttgccatattatcgccaaaggtacgaacaaaccaaatagaaagctgccaagctgcaatcattgccgtaattgctttttgactatcttcaatcccttcgtgaacagcttcattacctgcatttttgagaaaatgaaacattgacaaaatctcacgatcaaggcgacattctttcaatgcttttaaacgatcattttgcgtgatattttcaggcagtgccaaacgaaaacgtacggcaatttgcttggctaagaactcgccaaactggcggagtttatacattgacgtattcggatcttcagaaaaataacgctctgcaaattgaacctgtttgaataaggttggaaaggcttgaagaaaagagaagttggtttccattattcgctcctcggtttttatttaaaattattggcaaaattttggcaattataacaactccccacgaaatcctttcgccaaaatagcttgtgtcattaaatttacccgttccaaagctgcattgacttgggcttcaagctgattggcaaagtttaggtgtttttcgaccgcttgggtgatgtagttttgttcttcaagagttggtacaggaacaatcatatctctacattgacttaaagatatattaatttgcccaacaattccttttaaatcgtgttctatttctctaataaatctaccttctcgaaggacaaagtaaaaaaatttataatgtaaatttctaggattacatctaaaaagcgtaatagcttggttaatattccattcagaatattgatttgtaacaatcgtaacctttccaagtggcggaccaacaatattcatcaaaacatcattaggtaatgttattgaacgctgtgagtgttgttctttagttacaaattgaggtttgtaatcaaaatttaattcttgatttactatattataaactttcaaaaaaggaattgtgccattttgctcaaatggattacctttgggagttgaaccgctttgaactttatcacaaatatgttgtgctttttcatatacccaactatccaaacttaccccattttcttcccgccatttcgccgataattctccattaacagctcttgccagcacagattggcggtaagttttcagtaaagcagggattttctcaagccgttgtttgatttctgccacttgagataaaagtacggtgaattttttggcgagtttttgttgttgggaaaaagaagggtaaataaaatcacactctttcaaataacgaaaatggcgatgataacctttattaggcaaatttaatgacaaacactgataataaaaaaaatcaggatctatatcttttgcaggttgaaaaatttttacaccatcagcagcaacaataaaatcaaaatcaattaatttgaaatttcttgtatgatcaccaaaaacaattaccttattttcaacaggaataactttagtttcatcgttaaaatagcctgaaatatattcagcaccttgatcaataacagggtatttaccaacagataaacaatctttggttgagatatttttacctgttgttgatatttgggtaaatactttagttatatttattttattccacccttccggcaatgctttgtctttcattcaatttcctgtggggcaaatgatatttgcctaattaaatttattcggtatttattaggggctaatgtgattagcccctacaataaggttgaattgtataatgtccacgaaacatttaattcaatatgtagggacacactgcgtgtgtccacaaggggttaataaaatctaaaatgtgtaaaacattgagaacggacacacgcagtgtgtccctacgattaatttattgaaatgattggcaaattttacaactcgcctcttttcaacataccttgctttttcaaattcaccaataaaatggaaatcgccgctggagtaatgcctgaaatacggctggcttgtccgatagagactggacgatgttgcatcagcttcgcacgcacttcgttagataagctttccactctgtcgtaatcaaattcagctggaatttgggtgttttcgtggcgtttgtggcgttcgatctcttgttgttgatgttcgatatagccttgatatttaatcgaaatttccacttgctcggccgcttctttatcttcaatcgctggcgcaaaaggggcaatttgagttaaggcttcgtaagtcacttcaggacggcgaattaaatcttcaccgcttgcttcacgggcaagtgggctatttaataatgcattcacttccgcaaggttcgccatttgtaagtgcgtccacgtctgtttcaagcgcgctttctctttttcgatgttttccatcttctcgttaaaacgagcccaacgcgcttcatcaattaaaccaaattgatgggcaatcggtgttaaacgcgcatcagcattgtcttcacgcaacaacaagcggtattccgcacgagaagtaaagacacggtacggctctttggtgcctaaggtgcagagatcgtccaccaatacacccgtgtaagctaaatcacgggtcgggaaccacgcatctttgccttgtacttgtaagccagcgttgatcccagccaataaaccttgtgcggctgcttcttcatagccggttgtgccgttaatttgtccggcaaagaataagccgtcaatcgctttggtttcaagggttggttttagatctcgtgggtcgaaatagtcgtactcaatggcataacccggtttgataatacgggtgttttccaagcctttcattgaattgacgatccccatttgcacatcaaacggcaaactggttgaaatcccgttcgggtaaacctcaatggtggttaaaccttctggttcgaggtagatctgatggctgttgcgatcgctaaaacgcattactttatcttcaattgacgggcaataacgaggcccgatcccttcaataatccccgtgtacatcgggctacgatctaaactattacggatcaaatcgtgagtttgttcgttagtgtgtgtgatgtaacacggaatttggcgagggtgttgctcaacggatcccataaatgacattacaggtaaaacctcgtccccgtgctgttttgccaatacatcaaaattgatcgtgcgagcatctaaacgtggtggtgtgcctgtttttaaacgatctacacgcaaattgagatcgcgcaaacgatcagccaacatggttgctgctggatctcccgctcgcccgcctgcgtagttatctaaaccaatatggatcttacccgccaaaaaagtgcctgcggttaaaatcactgatttcgctttaaaggttaaacccattttagttactgcaccaaccgcacggttattttcaaccaaaatatccacgacttcttgttggaaaatatccaaattcggttgattttctaatgcagtacgcaccgcttggcggtaaagtacacggtctgcttgcgcacgagtggctcgaacagcagggccttttgaactgtttaaggtgcggaattggatccctgctttatccgttgccgttgccattaaaccgcccatcgcatcaatttctttgactaaatgtcctttgccgatcccaccaatcgctggattacaagacatttgtcctaaggtatctacattgtgtgttaaaagtaaggtttttaaacccatacgcgcaggagcaagtgctgcttcagtaccagcgtgtcctccaccaactacgatcacatcgtatatttcacgataaatcatcttatttgccttgattaaattctgtttaaatgaaaatttgtctattctacctgaaaaaagcaagatctgaaaaaaggttttgatctaaggttaataggatcttgattatgatcgccgatcttaataaaaaaagatctatttatataaagatctttattattgtagttattagtcttacgaagaactgtgaataactaagaaatatgtaataaattcaataagatctaaagataaaacgattgtgatgatcttgaaaaagagtaagatcttagttgtggataaagtggtaagttatccacagatgatattttttgataagttattcaagaatagatctcaagataaatacaggaaaaaagagagttatccacagatgaaatgaattacttttccctttttttgaacaatatctattctatttataatgtgacacaactcacagtttttaatggattagcttctcttttagaaaaaaatccctaaaatttgtgcagttcagttgtttatggataaactttatgcaacatcgtcagcaattaattttaacttacattgaaacctatcaagaagcgagcgtgcaggagcttgcaacacatctcaacgtttctttggaaactattcgccgtgatctgaataaaatgacaaaggaagacctattgtatagaaatcacggcggtgcggtaagccataaaaatcgtgatataggtcgttcttttgatgttcgtcgcagaatgaatagtaacgtgaaaaagtctattgcagaaaatgcattagagcatttttttgttggagctgtgataggtttagatgcgagttcaagtagctggaattttgcacaactcttacctgatctaccttgtacagttgtcacaagttctatgcacaatattcgagcattggcaaataaaaccagcattgagatcattgcaacaggtggtgtgtattcagcgaaatatgatgcattttatggctctctttcgggacatatactatctcgtttaaatatagatattgccatttgttcttgcaccggtattgcagacggtattgtgtgggaatctaatgaaatgaatgcaatagctaaacgaaaaatgctagcagcgagtaagaaagtatttttattggcggatcattcaaaatttgaacgtaaagatctgatacaactttgtgatctttctacaattcaccatttatttacgaatcgttcccctcctgattctattcagatgctttgtaggcaacatcaaattaatataactatttaaagtaaaataataatgtaatgctcaaattttgccctgcttctttattccgctaatcataaatctgggtttagaaacaaggcaattttgttttaagtctgctatttacttacttgagtcttgttgtaatcaggatgttttggtccaataagcaaaccaccgtttttccctaagtgaacaagatttgatgttgcaggtgctgctatttgatacccttcatctttactggtatccattatttgactcacagctgctttaactagcatcactagcagaccatcattactatttgatgatccttgtgcgaaagaaccaatcccttcccataaggtttttcctgtcttgagatcaactagttttccttctaaggatactttagttacgctatcaattaatttatagctcgtgccatattcctcaacattcacatagaagatcgcatctgcaccaaaaatttcacggattttgtttgtttttgctgagcggattgcattcccatcagttaaaccattctgtttgaatatttcatcaactaatgcaacaggaaaaacatagtaacctagctcacctaaaggatagcttgctctagcaagaacacttatatccgcctttgcatctacagagctatttgttggcatcactaccaaaattgattttggtttgctattttttaactcagtataatcataagaatccactttttgtttagcacagccagctaataatattaaacttgttaataaaacaaacaattttttcatagatgatccctattttttacgttgtaggtattgcataagcgttgtactttcaggatgtaattcctgctcttttttcatagctgtttgagcttcagcttgttttccctgttttaataaaacaagagctaaatgcccatatacaccgggtgcaacagttttttgatgtttagctgcttcagcaataatttgatttaaactttcttcttgcttaccaaaatcaccaggttcattataataatgatatataacatcagaataatttccccaatagtaaatatctttatttacattattagaagaacaagcagataaaatgatagagctaacaaggaaaatagtatattttatttttttcatattgattccttagtgagatggctgccaagagccagattcgataccatttacaaggttatttacagcttcacgaattgcaagatcaagaacttttccatttagtgttgcatcatagcttgcagttccaccaaaacctagcacttcacggtttgataaattatattcaccagcaccttgtgaggagtaaacaacttccgatgtttctacgttaacgacgtttaaggtcacttttgcataggctacttgttcttttcctctacctagaattccaaatagttgatgatcgcctacggttttacgtccaaattctgtaacatcgccagtaatcacataagttgcaccttttagattttgttttttacctttgatttttgcttcagaagcaatttcactcatatttgtacgatcaaccacagaaaaacgaccagtttgttgcaaatgagagattaaaattgtttttgattggttacctaattgatcaggaccatcagagaaaactccgttttggaaacttgatttgttatcaaattttcctactgaaataactgattttacgcctttatattgacttgcagttgtcgctgcctgagttgatgttggtgtaattacttttgaattttcagtagcacatccgactaatgttaatacagtaaggcataaagctcctactttcaaattactcataaaaaactcctgttaagatgaaaataaaacctatcaaatagatttatcaatatttgataccaatttcggtttaaaacgaaattagtacgcatattattatatttattttatgttgaaaagatgcccgattttcccctttctatcgccaaatcgggcaagtaaattgtaaaaaaattactcaatcttaccgcttagggctggctttttgtgaggcaattcacaaaatctgcacaaatttcgtaaaaattcttttttcatcgtcaataagtagcaaaatatcctcgtcagtttaaccagttaattaaggggatttttatgactcaactcaaatcaactccagtaaaaattggtatccgcccaaccattgatggtcgtcgtcttggggtgcgtgaatcattagaagatcaaacaatgaatatggcgaaagcggtggcgaagctcattagccaagaagttcgccatacaaatggggattttgtcgaatgtgtgattgccgatacttgtataggtggtgtatttgaagcagctgcttgtgccgaaaaatttaaacgtgaaaatgttggtgcggtgattaccgtgacaccttgttggtgctatggttctgaaaccattgatatggatccgcatatgccaaaagcgatttggggctttaacggaactgaacgtccaggggcagtttatttagcggcttcacttgcagggcataaccaaatgggcttgccggcgttctctatttacggcaccgaagtgcaagaagcgagcgatcaatctatccctgatgatgtgcgtgaaaaattacttctctttgctcgtgcaggcttagcggtggcgaccttacgcggtaaatcttatctctctatcggttctgtatcgatgggtattgcaggctctatcgttaatcaagagttcttccaagactacttgggtatgcgtaacgaatatgttgatatgtctgaactcactcgccgtatggaacgtggtatttacgacaaagaagagtatgagttggcattgaaatgggcaaatgaattctgcattgaaggtgtggatgtcaatgcgcctgaaaaccaaatgagtgcggaagagaaagctaaattgcgtgaaaccttggtgaaaatgaccattatcacccgtgatttaatggtgggcaatccaaaactggctgaactcaattttggtgaagaagccttaggtcataatgcgattgccgctggtttccaaggacaacgccattggacagaccacagcccgaacggcgactttatggaagccttactcaactctacttatgactggaacggcgtgcgtcctccatatattcttgcaaccgaaaatgactcgctcaatgcagttaatatgttgttcggtaacctcttaaccggtcaagctcaaatctttgccgatgtgcgtacttactggagccaagactccgtagaacgtgtaacaggctggcgaccagaaagtggctttatccacttaatcaactcaggttcagccgcattagacggtacaggacaacataccgataaagacggcaaacctgtgattaaaccgtactgggaagtgacagaagaagatggtaaacgctgcttagaaaatacccgttggtgtccagcggtttatgaatacttccgtggaggcggtttatcttcacaatatctcaccaaaggcggaatgccgtttacaatgcaccgcatcaatctcgtgaaaggtgtcggccctatattacaaattgcggaaggttggtctatcgacttacctgaacacgtccacgatattctcaacaaacgaaccaacgaaacttggccaaccacttggtttgtaccacgcttgacaggacaaggtgcattcaccgatgtttactctgtaatggcaaactggggagctaaccactgtgtagccacttacggacacgttggtgcggacttaattacccttgcttcaatgttgcgtattccagtcaatatgcacaacgtggcagataaagatgtgttccgcccaagtgcgtggagtatgttcggacaagataaagaaggtcaagattaccgtgcttgtgcgaactttggaccgctttatcgttaattaaaccttttctaacaaaatttccccctttgaaaaagggggattaagggggatttaaagatcggtgcgttaaattgcactatttaaaatcccccctagccccctttttcaaaggggggaataagataaaaggaggctctatgccaatcgcatttatcttcgattgtggtgcaaccaatttacgcatagtggcaatggatcatcacggcaaattactggcggtacatcacattgcaaacaatacccaacaaggtgaagaagcaaccgactatcacatttgggatattgatgagatctggtcaaaactgatgacctgtgccaaacaaacccttgcacaacttacccctgaacaacggcaagatattgtcgggatttcggttacgacctttggggtggacggggcgatttttgacaaacacggcaaacagctctacccgattatttcgtggaaatgcccacgcactcagccgattatgcaagcgctcggcgattatctcgatgtggaaaaactctaccaacgaaacggcgtgggacattacagcttcaacacgttattcaaattactttggttgaaacaacataaacccgaactttacgcacaagcggagagtttcttgtttatttcttccattcttacttatcgtttaacgggtgtacaaagcaccgacagaacaatggctggtacatcaatgatgaccaacattgcaagcgactcgtgggatagcgaagtgctagatgtgttgggattaacagcaaaccattttccaccgatgaaaagtgcaggggaaaaaatcggtacattactgcctacacttgctgaagagcttggtttatcggcggatatttctgttctctcttgcggacacgatacccagtttgcgatcttcggctcaggggctggctacaaccaactggtattaagttctggcacttgggaaatcttaatggctcgcacccaacaagccaaacccgaatggcaatatgtcaaagatggcttaaccattgaatttgacagccaagcaggctatttcaacccaggcgtgcaatgggtcagctcaggtattatggagtggctcggtaaacgcttctttagcgatgttgcaggtacagccgactattatccaacgatgattaacgaaggatcacaagttccagcaggttcgaacggcgtaaaactagtcggcaattttgacggtaccagccaacaaacaggctcaatcgaagggctatcaatgcacacccaacggggcgaaatttatcgtgcaggtttggaatatatggctcaccgcttgaaagccggacttgaggtattgcaacaagtcggacagttcaatgcagaaagtattatctgtgttggtggcggttcaaaaaacggcttatggaaccaaatccgtgccgatgtgcttaaccgcccaattgatgttgtcgatatgtccgaaaccacagtgttaggcgctgcgatgttcacgctcacaggtgcaggcgtattcgagaatatcgaacaagctcaacaggcaatgaaaccagcgtttaaacgagttgagccgagtgggaatgtgaaaatttatcaatgaaacgtagggacacactgcgtgcgtccacttaataaaatcatatccaacggacacacgcagtgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgctaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtatgcgtaaactgctaaccattatgaatgcgttggttagacgcaatgaaaaatgggacgctacacgctacttatccacagaatctgtgggtcaaaattgaataacttttttgtgtgtaaacacagttgctacaaagatttggagaatatatgttaaaaggcattcaccctgcactttcccctgaattgctgaaagtgcttgcagagatgggacacggcgatgagatcgtcttatcagatgcccattttcctgcacatcaattacatcataaagtgatccgcgcagatggcattcaaattgccaccttacttgaagcgattaccccattatttgaatatgaccaatatgtcgaacgtccactggcaatgatgcaagcggtacatggcgacagccttgatcttgcggttgaagaacgctatctcgccgcaatcgcaaaaattaacggaagagcaccgcttgttgaacgtgtagaacgcttcgccttttacgaccgagcaaaaatcgcttatgccgtagtgattacaggcgaattagccaaatacggtaacatcatcttgaaaaaaggcgttaccccagttttaacagattaggaggagagtatgaatcgtcaaacattagcgagaaaaattattgacacctgtttggaaatgacccgtttgggtttaaaccaaggcacggcaggaaacatcagtgtccgttatcaagacggtatgctgatcaccccatcaggtatgccttatgaaaaaatgacagaagacgatattgtctatgtggataacgaaggcaattttgaagcaggaaaactgccgtcaagtgaatggcaatttcaccttgccgtgtaccaaactcgtccagagttaaatgcagtggtgcataaccacgctatcaactgcacaggtgtatctatcttaaataaagatattccagctattcactatatgattgctgttacgggaacaaatcacgttccgtgtgtaccttatgctactttcggtacttggcaacttgcggagtatgtaaaacaaggtatcgcaaaaagcaaagcgattttattacaacatcacggaatgattgctgctgaagttaatctggaaaaagccctttgggttgctcacgaagttgaggttttagcggaatggtatctgaaactcttggcaacgacaccagatgtcccagtcctttctgatgaagaaattaaagtcgttttaggcaaattctcaacttatggattgagagttgaagagaaacattaatttgatgttatgttagaagggcgagtagttaaattactcgcccttttactatgaagcttttcttaaggctaatgaaacagctatagtttgagctaatgtcattgtggcacattgtgaacggaagccgctaatttgagcttctttaataataaaagaaacatcactgaatgtaagcagtgggctaagttggctatctgttatagctatgtgttttacacctgtgcgagcagttgcgtctagtacagatattgtttctgtcgcatagggtgaaaaactgattgcaataacgacatcaccttctctaatcctatttagttgttcactaaacataccacctaaaccatcaattaaaaatacgtcgtaattcaaatggcttaaggcataatttagataacttgcgatactaaaagatcgttttaaaccaacaataaaaatacggtttgcattatctagaatttttgtaacggcttctaattgttcttcggtaatttgattggctagttgagcgagagcttgattatttccttgaataaataagcgaaggacatctgtatgatcgcctttggattcatttaatttaggttctatttgacgaaaaagttgaactcgctcagtataacttgttgttccttccatcaaattttgtcgatagagttgttttatatcgttaaatccacttaagccaaaagcattcgcaaaacggattagggtcgaaggcggtacttgtgctttttcagcaatttcagaaacggtgtcaaaaattacactatctccattgtctaaaatatattgtgcaacttgtttgagtcttttacttaacgagtcatattgtttacgaacttcattttgaaaatgggttaactgggtttcttcattcatttcattcagattattattatcaaattaagcacaattatactgtattttgttgctttttaaatcaaaacacccctaatatttatcatattaggggtgttttatgtttatttagtatgcaaaattagcgttgcttccaataacgaatcagagtttgataacgtaacgcaactgcatcaattaactcttgatcattcaactgatttgctaaccatttttctgatgcctcaccaaaaatggtgcgacctacggcaaatcctttcacttttgagtaatctttagatgctttgaagaccgcttcaaatacttctgttggtgcatccagcccgagaattaagataccacggcaatctggatcgtatttatctattgtttcactcaatttagcccagccttctgcagaaatacctggtaatttccaccattctggttttatccccaattgatagaagtgttctaccatttcattatagtgattttcatcttgatccatggttgctggtagaataatttctaacaacaattcatgcccagtacggcaacaggcctgatacacttcttttaatttacgatcttggcgttgacgaagttcttgattgtcttgtggatggtaaaatgctaaacatttaatcacatgatttcgtgggaatgtaactaattggctacctaaatcaccgtgctcaagttctaatggacgagaacttggttcttcgattggacgagcaatccaataattttttcccgtaatttcattaagagcatcttgaccaaatgtcgtatctgcaagaatacctgcatttccatgagttaaaccttccgcttgtgcggtttgttccatcgctttaagcagtaactgttttaattttggaatgcgattaacatcagcacctaccttagctgccatatccactaattgtttacgatgatcaaaagcaaaaatacagagatcatcccactgttttttgcgtgtcgttactcgatgtaagtgatttaatttttcatctaaatcaggacgaggtacacttgctgcacggctgagatagtcatctaattctcgttttgtcggcattgcaggtgcacagccgtgacgggaaacaactaaagcaccacaagcattagcataacgacaggcttgttcccacccttcattatttgcataacctctgagtaaaccagacataaaggcatcgccagcaccaagcacattcagtacttctacccgtacaccatacacatttaatccgccatcaatatgatttggaatatcaccttcaaatacagagcaacctaatgcaccacgtttgcaaactaatacagcttgggtaaattggcgtacatttttcaatgcggttaaggtatctgttgagccacctgcaatgtgaaattcttcttctgttcctacaattaagtcaaagtgatgaagcacttcttgaagggatttagtcacttcctgagaatcaatatagcgagtttcgccatcacctaaagaggttaaaccccataataccgggcggtaatcaatatctaatgcacgttttacgtcattacgacctgcatattctaaggctgttaaaacggtttctcgtgttttagggtgagaaagatgagtacctgtaatcgctaaaatacgtgacgaagcaatgtaactttcactgaaatcatccttactaatcgccatatcggcacaattctcacgatagaaaatcagcgggaaggtttccttatctttgataccaagaataacgagcccagttaaacgctctttatcggtaattaaatggctagtatcaacacctacgcttttgagctcttcacgtaaaaaacgccccatatgttcgtcgccgacgcgagctaacatagaagaacgtaatccttgaatagcggtgccatacgccacattcccagatgagccacccaaatattttgcgaagctcatttcctcttcaagccgagaaccaatttgttgaccatataaatctaccgcaactcgtccaagacagatgacatcaagagggcgatcttgatgattaacgtatgccataacaatgcctccataaaataattgaaaagatcttggttttcaatcatcatacaaaaatgaaataaatatttcaaattaaacttaattttttatttgtttttgtgaccaacatcaaatctttaactattagggaatcaagtttaaaaaatgcgagatagatcacatcattaactaaaatgctttgatattataaaatgaaataaatttttcataatgtgaaaaactgctttaattttatctctaacctaggagggagtatgcagactatcaaactcacagtggcacaggcacttgtgaaattccttgataatcaatatattgaaattgatggcaaagaaattaagtttgttcacgggatcgctgctatttttggtcacggtaacgtattgggtatagggcaggcgttagaacaagatgcaggctcattacgtctttatcaggggcgtaacgaacaaggaatggcacatcttgcaataggttttgcaaaacaaaataaacgtcagaaaatcattgcttgcacttcttcagtcggtccaggtgctgccaatatggttacagcagcagccactgccacagctaatcgtattcctcttttattattaccaggtgatgtatttgcaacgcgacaacctgatcctgtattacaacaaattgaacaaccgcacgatttaagtattagtactaatgatgctttccgtgcagtgagcaagtattgggatagagtacaacgacctgagcagttaatgagtgcttgtatcaatgcaatgcgggtgttaactgatcctgctgaaacaggggcagtgacaatagccttaccacaagatgtccaagcagaagcctatgacttccctgtaagcttcttacaaaaacgagtacatcgcattgaacgtacaccaccaacccaagagatgctggctgatgctgtcaaattaatcacctctaagaaaaaaccgcttatcgtttgcggtggtggtgttcgttattctcaagcgtgtcgttcattacaacatttggcagaaaaatttggtattccatttgcagaaacacaagcaggtaaaagtgcaattgtttcaagccacgagttaaatgttggtggtgttggtgaaactggctgtttagctgctaaccgtttagctaaagaagctgatttaattatcgggattggtacacgttataccgatttcacaacatcatcaaaatggattttccaaaatctagatgtcgctttcttaaatattaatattgctcgttttgatgcgtataaattagatggtgttcaggtgaccgcagatgcgaaacaatccattaatgcactgattgataagctaccaccaggttataaaacgcaatggggagatgctattaaacaagccaaagcagactttgctgacgaattacaacgcttacgtcaggtaaaatttactgacggatttgtaccagaaattaatgataatcttgatcatgatgccgtttatgctgaatttatcaaactcaccaactcttgcctaacccaaagccaggttttaggtattgtaaatgaaacgattgataatagtgcagttatcgtaggtgcagcaggtagtttgccaggtgatttacaacgtacttggttaagtaagagtgaagacagctatcatcttgaatacggctattcttgtatgggatatgaagtcaatgcagctgttggtgtgaaaattgcacaaccagagcgtgaagtatatgtgttagttggcgatggtgcgtttttaatgtcccactcagaactcgttacttcaattcaggaaggcaaaaaaatcaatgtcgtgttgtttgataatatggcaaatggttgtattaataacttacaagttggtaacggtatgggtagctatggtacggagttccgcttccgcaatcctgaaacaaaccaacttaatggtggcttaattccagttgactttgcaatgtgtgctgcagcttatgggtgcaaaacctacaaagttactaccgaagatgaattacgcaaagccttagctgatgcaaaacaacaaaccgtatctacgttaattgatattaaagtattaccaaaaacaatggctcatggctatggttgttggtggcacgttggtgttgctgatgtttcaacgagtgaacgtattcagcaagcacatcaacgttctaaagaacagttagcaaaagcaagaaaatattaattacaagcggtacgatttgtaaaattttttgcaaatcataccgcttacactctttctatttatttctcaatgaggatttcactatgaaagctgaaaacattcaattaggtattgcccctattggttggacaaacgatgatttaccggaacttggtgcggaaaacacatttgaacaatgtgtgagtgaaatggcacttgcaggctacacaggctgcgaagtaggtaacaaatatccacgtgatgttgctgtccttaaacataaattagatgtccgtggtattcaaatttgtaatgcatggttcagcacattctttgttgatggcaaacgagaagaaaccattcaagaatttatcaaacaccgtgattttctacacgcaatgggggcaaaagtaattggttgttcagagcaaagccgtagtattcaaggtacaacaaaagcagtatttaaagaaaaacccattttcaatgatgaagactggcaacgtttagctgagggttataatgaattagccaaactcgctgctgaaaaaggaatgaaagtcagcctacatcaccatatgggaacaggcattcaaactccagaggaagtcgatcgctatatgtctgtcgtcaatgatgatgtttacttattatttgattctggccacctttactattcagaaggctgccaaaaagcgatgttagctgtacttgaaaaatatattcaccgtatcgtacacgttcacttaaaagacgtacgtgatgaagttgttgcagaagtcaaagccaaagatttaagtttcttagaaggtgtgaaaaaaggtacatttaccgttccgggtgatggtgtaatcgatttcaaaccaattttcgatattcttgaaaaatacgactacaaaggttggatggttgtagaagcagaacaggatccagcattagctaacccatttgagtatgctttaaaaggtcgcaaatatattcgtgaagtcgcaggagtttaatatgttaaaagttggtattattggtgcaggtcgtatcggtcgtgtacattcagaaagtatctcaaaatatgtaaaaggtgctgaaattaaagcgatttcagatattaaggtcactgacgaattaaccgcttgggcaaaatcaatgggcattccgaatgtctatgatgattacaaaaaaatcctacaagatcctgaaattgatgctgtattggtttgttcgtcaaccaatacccatgcaccaatttcaatcgaagctgcacaagcaggtaaacacattttctgtgaaaaaccaattgatgcagatgtgggacgtattcacgaagtattaagtgctgttgaaaaagcaggtgtaaaattccaagtaggttttaaccgtcgttttgaccataacttcaaagcaattaaaaaccgtgttgcgaacggtgatattggtgaaccacatctcattcgtgtcacttctcgtgacccagatgcaccaccaattgaatatgtaaaagtatcaggtggaatgttctttgatatgactattcacgattttgatatggtgcgttacttatcaggtagtgaagtggttgaagtgtttgcggctggcggtgtattagttaatccagaaattggtaaagctggtgatattgatactgcagtgatcaccttaaaactagcaaatggtgcaattgcagtcattgataacagccgtaaagcggtatatggttacgaccaacgtgcagaagtctttggttctaaaggtgcggtacaaactcgtaacgatacggattcaactgctgtatattcttgtgaagctggcgttattgcagaaaaaccaaaatacttcttcttagagcgctatatgcaatctttcgcagatgaaatggcatgtttcattgattctgtggtaaacaataaaccaacactcgtcaacggtaacgatggtttacaacctgtcttaattgcgttggcagcgaaaaaatctcttgaagaaaatcgtccagttaaattaagcgaagtcgcttaattctcccgatacaagcggtacgatttggtaaattttttgcaaaatcgtaccgctttcatttttattgattaaggtaaatttagagtatcaaatcagtatttgagacataaaaaaacttagccacttggctaggtcttgttatttatagcttagattatttagcttcagctcttgctctttctgccattaatcgttcttgttctaatgactcagcatcttggttttgttctttcgctatacagattttttcatacattttgaagaatggatagtaaatgaaaatatcgagtatgattaaactcaagcttaagataggagcccaaacatcaccacctgataccaaataagctccgataggtgcaggggttgtccaaggtgccattaagtagatgcggtggatgagatcaaagtctaagatgagataagcgatgatcgcatttgccattggtgcaaagattaatgggataaagaagagtgggttaaccaccattggaacaccatacacaatcggttcaccaattgagaagatagacggaaccaaaccgattttaccaattgagcgtaaatgtgcagagcggctgcgtacgagtaggattgctaatgcaataacaccaccagatgcaccatgtacaatgtagaagtcccaaaatgagttagtaataatgaatggaagtggttctcctgcctgtaatgccgctaagtttgccgccatattttgtaataggaatggtgtccaaagttgcattaatacaagtgatccgttaatacctaggaaccataataagtgcgttgcaaatacgaataaacagattgcaccaagagagtcactcactttaattaatggagccataaagtccataattaattgtggaatattcgttcctgtggcgtgttctacataaagggcaaatgggtagagtgtcactaatacagctaaaattgggataacaatattgagagattcggcaactgctgttggaacttcttttggtaagcggatgcgaatatgcaaatactcaagtaagcgtgttaattctacggtataaattgcaatgaaaatagaggagaaaagtccaataccaccaaagaatttaatgtccatcataccgtctttaactggggcggcgactaataagaaagccatcacagataagaacgctgcaggcagtggctcacgtttataggctttagccaagttgtatgcaatacttcctgcggtaaataatgaaatggcattaaatgacatttggaagaaacgccagccatagtcgcttgcccaacgagcaaactcccaccacgctttaccaaatgcattttgcgtattctcatcaaaaggtggaataagcaaaatcatgataaaactaccgacaatcaaaaatggtaatacaacaataaaaccatcacgaattgcagaaatatgtggttgattttccatccgttttgcaactggtgcaacgtggttgttcataaaatcaataaaacgtcctgatgtggttgacatactatgcttctccatttgcaattttgaaacctaacatataccaatcttcttgatagttttcgatatgtaatgttctgccttttccgttgtgctcaacgttaaacttaacagctttattgagtgcttctaactcaccaaatattgaaagcggtaagttattttgtccgttttgcaatccatcaataaagagatagagatcagtgcctacttttgtgtaataggtggtgagattaccgattttttgcgttgggaatttactgcatcttgaatggtagataccttcgccgttgatatttagccattgtcccaatgcgagtaagcgctctacttgttcttcaggaattgttccatccgcttttggaccaatattgagcaataagttaccgttatcggcgacagtttcgactaaaagagagactaaatctttaacagagatcaggtggctttcatcttcaatttggttgtaaccgaaagaaagccccataccacgacacatttcccattttttatcacgagaagctgttccgtgcttatactctttagaagtaaagtcacaccaaagtttattccaacgatcatcaacaacaccgtctgtaacagaattgtagtagtgagcaaaaaggtgtggaagcatatgttcccctacttttggccaaccaatatcgttccataaaacatctggtttatagcggtcaatcaattcaataacttgtttataagcaaagtcggcatattcgtaagttgggcaagcattagagaaattttggctttctgtgaaaataggtgctgaagaatattgccagtcgataataccagagtagtacgctcccatacgtaatcctttttctcggacttgttcggtgagctcacccattaaatcacgttgaggacctgctttggtgcagttgaaatcggtatatttacttggatataaacagaaaccatcgtggtgttttgttgttaacacgacatatttagccccggcttgagcaaagagttcagcccatttttcaggttgccatttttctgctttccattgcggaataaactggtcgtaagtgaaatctttaccataggttttaatgtggtgttcgtaagttggccctttttgaacattaatggaattaaaataccattctgcgtacggattattacagaaccactgctcatcaatatcaatttcacctaattggcaagtcggtggtgcaaatgctgggacagaatagacaccccagtggataaaaataccaaatttagcatcttcataccattggggtacctcatgggttttgattgactgccagtctgcgtggtaacgtttttgtttagtgtcagtcatagtaggctcctatttttagcatacataaaaataaggtccgcatatattgtgatatgcagacccttccgatttcatattaaatttctttcacatctacccagcgtttttcttcagcggatttagcgatggcttcgagaactctggatactctatatccttcttcaaaatctggccacattctgtcatctgcggcgataccattgactaaatcacggatttctacgcttttttgatcattaaaaccaataccgtgtcctgcacttacgcagaatgcggcgtagtcaggatgttctggtccaacgagaatagttttaaatccttgacgagatttatcttcatcatgtaaataaagtttaagttcagccattctctcttgagtgtaggtcaatgtgccttttgttcctgttaccacgtaggtcaagcccattttacgaccgcaagcgatacgagagctttcaatcgttcccatcacaccattggcaaaacgcaccatagcggttgcttggtcttcgttttctactttcactttttctgaaaggttatttggatttgggcgttctgtgataacggtttgcatatcgcccacaaccgaggtaatttcttcaccgactaaataatgagccatattaacaatgtgagctgcgagatcgcctaacgtacctaatcctgctttacttcgatagcagtgccagtcaatcggtgtatttgggctagcaagatagtcttcattatgtgtgccataaaaatgcactacatcaccaatttccccatttttgataatttcacgagcaagttgtgaggttggatttttcatataattgaaaccaacgagagttttcacacctgcttttttagccgcttcaaccatctcttttgcatctgctgcagttaatgcgagcggtttttctgaataaacatgtttaccgttagcaatggcagctaaagcaatttctttatgtaagaaatttggggtacaaatatctacaacatcaacattcggatctgcaaccagttctctccaatctcctgttgctcgagcaaagccaaattctttcgcttttttctctgcaagttcttgattaatttcggcaagatactcaaggtgtagttcgcctttcagtgggaatagtgttggtgcttgtgcataagcaatcgcgtgacaacgaccgatatagcccgtacctactaaaccaattctcacttttttcatacaaagctccttaagttgtaagcggtatgatatacagaaaatgttgcaaacttttagagatatcttgccgcttgtaatctatatatttatgcgactatgcggcttttctgcggcgttttaatgtatcgagcaatacagcaatcacgataattccacctttcacaatttgttgccaataagggtcaacgcctaacatatttaatcctttattggttgtgccgataattaaagctccgataacacacatcggaatagttccaaagccaccgcttaatgaaacaccaccaataactgccgcagcaatcgcatcaagttcccacgctaagccataagatgggttacctgcataggtacgagctgcaagtaatgcaccagcaagaccagataaagcccccgcaaaggtataaacaagaattaatgttttcgttgtattgattccacagatttttgctgcgttgagattaccacccacagcataaacgtgacgaccaaaggttgagcggcttagtaaaatatgtgagccaataacaatgagaatatagagaataactaatcctggtaagcctagaatgtttacatcggcaatccaagtaaaggtttcagatgaagcatcgatagggcgtccagcagagtaaagctgtgcagcaccacgggcaataatcatcatacctaaggttgcaatgaaaggcggaatactaccgagagcagttaatccaccatttattgcacctaaaaaagcacctagagcaagagacattgcaaaagctaaaatggcagaactagctaaatctccccctgttaccattgaggctgcaactacggaggttagtgcgacaacagatccagaggataagtcgatccctgtggtgataatggcaaacgttactccaatagcaataataccgaacattgatacttgctcaataatactccacacggtacgggcagagaaaaagccttcgatagaaacggataataggagaaataaaataattaaaattaacaccattccatatgtattaattattttctttaatgttgcttgtgacatagtacatacctcgctatttataaataatatggtttgagtctttactgttttactaatccagatgcaaatgctaggactcgttcctgagagagttcttgatatggaataatgccaaccttatggccttcgtgcataaccattacgcgatcgctcatcgataatagctctaacatatccgaagtaatcataatgatggttttaccttgttttgagagttctaccattaacttataaagttctgccttagctccaacatcaatacctttggttggttcatctagaatgaggatttcaggttcgagaagtaaccaacgagcgagtaatactttctgttgatttcccccagataagttattggtgatgacttctacatcaggtgctttaatttttaatttatctttttgctcattggcggttttatgggatttatcaatagaaatgagaaaattctctaaataaggcgacatttgaggcataatcatattgtcgataatatttaggttcaggaataaacccgttagttttcggtcttcagtcacaaagccgattttatgttccattgcatcaagcgggttgtttatctcaacttttttcccgtgaatataaatttcaccactatccgcaggtttataaccaaacaaactttctacaatttcagaacgtccagccccaactaaacccgcaataccaaagatttcgcctttacggacagagaaactaacatcttcatatttacctgctcgagtaaaattcttaatttcaaggacgatttcatcaggtaattcaaaacgttctctttggaacatttctgacatatcccgtccaaccatcattgaaattaattcttctttggttacatcagtagtggcttttgtacccacatattgtccatctcgaataacggtaatttcatcagatactttgaaaacttcatcaagtttatgagagataaagataatggcgataccacgttttttaaccgcatcaatgattttatatagttgttctacttccatttcggttaaagcggttgttggttcgtccataatgatgattttggcatcattagaaaccgcagtagcaatagcaactaattgagcttttgcaactgaaacttcagacattttgacggtaacgtccattggaataccaagctcagagagaatttctgctgctttgcgatccatctctttttgatttaataagaattttccttgagtaatttctcttcccaaatagaagttatcagcaatagttaaatttgcagcgggagagatttcttggggaaccattgtgagtccactacgaatagcatcaatagggcgagatggtttgaacggtttatcatctaaaattaattcactaccgtcatcaggaatatagataccatacaggattttcatcaaggtagatttacctgctccattttcccccattaatgcgtgaattgtgccacgttttacttttaagttgataccgtccaacgcttttaccccggggaacgttttagatacatttcgcatctctaaaatgtaaggggagctagttgtattcatttttgactccttggtttttaaggatgatttatcgttttgtcctcatagattgagaataaaagagataacttattaaagggtaaattcaccctttaataagtttatggttaattatttatattttgctctgtatttctctttcatatctggagtcactaattcaaaaggaacccagttgtatttttcaacagcttctccttttgcgattttataagcgatttctgctccagcgtatccttgtccttgagctgattggaatactgttgcgtctaagccactgcctaagtattcaagagcatctggtgttgcatcaacacctacaataatgatgtcttcatctttaatacctaacttgcggcttgcaagtactgcaccaattgccatctcatcattgttacttgcaataacattgatttttttgttagcggcaagtacgttttctgtaatggtgagacctctgtctctttcccatttaccttcttgttcagaaactactttaacgttacctgttctagcaaagatttctttcacaccctctgaccgtttagctgttgcatctaaaccaagaatacccattaagattaaagattctgcagatttaccatttaaagcatttacaatgtaatcaccttgaatacgtccagcttcaatttcatcagaaccaacatagctagtaacatattgcatatcttcatcgtttggtttacggttaacaacaattaacgggatattcgctttcttcgctaatctcccaattctcttcacaatttgtggatctgttggaacaactaataatgcatcaactttttgatcgataaagttttcaacatcatttaattgacgtgcagggtcaccgtttgcatcagtgagtttaatttcaacgtcattatgttttgcatcaaaatctcttacagactcttgtaaataggtttgccatttatctgcaaatgcagccattggtgcaccaataacaatatttttggcagatgctgtttgagaaagtaataaaccactgcataaaacagctaataatgcttttttcataagccactccttaaaggttgagcgaataacgaaatctctgaaataccactatattgcacaatgtcataagaaatttattgtgaatataaatttcaaaatccaacaatttgaaataaattgtctaagtgtatgtataacatttagtatttatgtaggcaacgactagattttaattttgtgaattagatcgtgttttttatgtaaattttttgttatagacttttgatgatgctaaaaatttagagaatatgtttttgggaaaaaaataacctaacgttgaagttaggctatttttttatagtgttagaattgagagagattatagtgttggcatactaaaggcagcttgtgatctcacactattatctggccaacgtgttgtaatggttttcatacgagtatagaaacgaacgccatcgctaccatacacatttaatggaccaaagatagaagctttccaaccaccgaaacagtggaatgccatcggtactggaattggaatatttacgccaaccatacccgcttgtacatcttgggtaaattgacgagctgcatctccatcacttgtaaagatagcactaccgttaccataaatgtgcccattaataatagacataccgtgagcataatctttcgcacgtacaacgcaaagaactggaccaaagatttcttctttataaatagtcatatcggttgaaacgttgtcgaataaggttcctcccacaaagtagccattttcatggcctgcaactttatacggacgaccatcaacgcaaagtttcgctccttgttctacgccttgatcaatatagctgatgatttttgctctatgttcttttgaaataacaggccccatatcattttcttgttgaccttctggtaaaattcctggtccaatttttaatgcttgtacttttggtaccaaggcttcaacaagtttatctgctgcttcatctcccacaacaacagcaacagaaagtgccatacaacgttcacctgccgcaccaaatgctgcaccaagtaaggtatttgctgtactttgaatatcggcgtcaggcataattaatgcatggtttttggctccaccaagagcttgtacacgtttaccatgagctgaacctttctcataaatgtattgagcaataggagttgaacctacaaaactgactgcttgaatacgagggtcggttaataaaatatcaacagcctctttatcaccttgaacaacgttgaatacaccatcaggtaaaccagcttcttttaatagttcagctaaacgaatagatacagatggatctttttcagatggttttaatacaaaagtgttaccacaagctaaagcaatagggaacatccacatcggcaccattgctgggaagttaaatggtgtaataccagctacaacacctaatggctgctgcattgagtgaatatcaatacctcgtccagcatttgctgagaattcccctttttgtaagtgagggatgcctgtcgcaaactcaacaacttctaaaccacgagttaattcccctattgcatcagagtaaattttgccatgttccgttgtaattagacgagctaattcatcaaagtttgcttcaagtaactctttgaatttaaataaaattcttgcccgtcttaatggggactgttgcgaccagttaggaaatgctttatctgcagcttcaatagcttgattgacttctgctactgtgctgagtttaacttttttaatttcttctcctgtagctggattgaatacagaagaaaaacgagagctggcactctctacttttgtaccattaatgaaattctgaacaaattggctcatgtgtgtgctcctatgaaatataaagtagaaggaattctagacaataacggtgcaaagctacctctaaaaaaagaaaatttcaagctaaaaatcattaaaatgaaaaatatatttcatttttgtgatcagtatagaaaaatgagcattttctaatacaaaaaagtgtagatattttttatagtacaaacttaggtcaataatatttaatgtgaggtatttatgagctatttactgtcaaaaagtcaaaaacacggacaaatccagcacattacaccagaaaacgcaaattgggagtatgtaggttttgatgcttaccttttgagtaaaggagaagaaattacattagagagtgggacaaatgaactctgtctagtatttgttgcagggaaaggcaacgtaatcaccccaacagaagtttttgaaaatattgggaatagatctacaccttttgaaaagattcctccttatgctttatatgttcctcatcattaccaactaaaagttgttgctacggaagatttagaactggctgtttgttgtgctccaagtaatggtgatttaccattacgcttaattaagccacaagagataggcgtagaaaaacgaggggtcggtaataaccaaagattagtacataatattttacctgaaactgagcctgctgatagtttattagttgtggaagtctttactgatgaaggcaatacgagttcttatccaagccacaaacacgaccaaaaagattctccaaatgaaacttatcttgaggaaacttattatcaccgttttgagcatgcacaaggtttttgcaatgcaacgagtttatactgatgatagaagcttagatgaatgtatggcggtttatgataaagatgttgtgaaagtacctaaaggctatcaccctgtggcaacaatcgcaggttacaacaattattacttaaatgtaatggcgggacctgttcgtaaatggcaatttacgtgggaaagcgatcatgcttgggtaaacagtatggcttatagtgagaaattcaaatagatactctactgaaacgtataatatctttctgtttaacctgcccgattttcctacatttttcaaaaaatcgggcaggttctttttgtgaaaaaataatcaataaatgattttttttgtgacacctttcacaaaattaacatctcaatgtaaatccactttgaaaactgtcaattttgtacaaatatgctttccgttacctaggtaaaccatttttattattgtaatggaggcagagatgaccgcagtcaataacaatacgccgttactctcaatgaagaacatcagcaaatcttttgtgggagttcaagccttaaagaatgttcagcttgaactacataagggagaagcccacgctttaatgggtgaaaacggtgcttgtagtggtacactaatcctgtactggagtatctatcttaaataaagatattccagctattcactatatgattgctgttacggggacaaatcacgtttcgtgtgtaccttatgctactttcggtacttggcaacttgcggaatatgtaaaacaaggtatcgcaaaaagtaaagcgattttattacaacatcacggaatgattgctgctgaagtcaatctggaaaaagccctttgggttgctcacgaagttgaagtgttagcggcactttacctgaaattattggctacaacaccaaatgtaccagtgctttctgatgaagaaattaaagtcgttttaggcaaattctcaacttatggattgagagtagaagagaagcattgatagtactagagtaacaactatattattaaatatatgcttgcggatagtacttctccgtcaattgcaccaacattgccagcgagattgttggcaatgtggtggttaatcctcttgcctctatatcattttgtaacacaaaaactgtcttgttggtaaaaagttgtgggtattttaccgcttgtaatacgccatcttgccataacacgatggcatcatcaggggtaacttgttcaagaatagcgtttagtgttgataagtcatattgtgctttggaaaatgtatagagcatagtatgtccttagaatgtgagtactttttcggcttgatgcagggtatcaaataatgctgttcggctaacaaaacggagttcgggtagtatccattctgcgtgatgtagcccacgctcatctactgattgttggcagacaaaacattcggttaaatcatagagatcgattagcttgaatgtggatatatgatctttttgtagaatcttttcaggctgttgattagcaactagattgaatacgccatcattgagaaagcaaatggcaatttcatcttcattgcaaaaagcactggcagccaacagggcatcaagaccttctcggcttgttgatgtgccaaatgggggctgagtaaagagaatagcaagtttataacgtttcattttaaatagtcagtaatcgatctgcagtaaataccgcttggctaaattcaccaagacctgcaagggtaaaaccttcagcgagattttgctctacaatgccacgccgttgagcagctgcaatacagagatgtaacgacaagcggtgagattgggctaagcttttccaagcctcaaccaaattcagttcatcgctggctggatcaataagttgatttgcattgctaaccccatcttgaaaaaagaatatttgttcaattctatgcccctgagctaaaagtgcttgagcaacttgataggctagatacgccccttgtgagccatacaccccgtgttttactgccaacacatatcgcattattcaccgtcctgtttgagctggcgaatgtagagataaaccgtgtggcgagagatctctaagcggtcagcaacttggttgattgcatctttaatatcaaaaatacctttttcaaataatgcggtgacaatatgacggtttttattgctgttagaaatgttgcggtcgttttttatttcgacaatggtgctttcaatggtttgagccaccaagtcttcgacagagcttgcaaaattcactgagccttcgctctctggtggggcaataaaactatttaaaaattgcgatacagggacatcaagattgatattgatgcaaattaagccgataacgtgttgtttgccgttgcgaatggcaatggtgacagatttcatcaatactccacctttggcacgggtgaaatagggtttggatacgctgtcggtttgcatatgatgaagtgaccataaagcccgatctgtaatcggcgagccaattttgcggtcggtgttatgcccattgacgatataaatcgcagagtgttctaagaactcaagggaatgcagtacgatttcgcaatgctcaccaatgagagctgcaataccatcaacaacgggaaagtaggaagccaaaatggcgtgatcttcatcagaaagcggattgaattttgctgtcatactttttcgctacataaaattaaaaataagggcacaaattgtgcccctataatgcgtttaagtaaacttattttgtagatttaaaatctaataattcgatttcaaattttaatgtggagttcgccgggattttccctgcttgacggtcgccgtatgccagttgtggtggagcaacaatttccattttgccaccttttttcaacatagggattgcttcaacccaagctggaattaattgatttaattgaaactcaatcggctcaccacgatcgtaagagctgtcaaacacagtaccatctggtaatgtacctttataatgtacttttactgtatctgtcgcttttggagcttcgcctgagccagctttctcaattttatagagtagcccagattgagttttcttcacgccggatttttttgcatattcagcacggaatttatcgccagcctcaatggttgctttacttttttctgctaggattttagtttcttgttcaactaaataagcatctaacgcttttaattgtttttgtaaatcttcatcggttaacttaccgctttttttcaatgtgtcttgcacaccagctaaaacacgttcttggttataagaaaaaatctctttttgagaagaaataacatcttcgatatttttacccatcaatacgcccacagcgtaagatgaatcatcaacaaatttagtatctgctttttctgcaaacgcagcttgtgcaataaacagagagcttgtcattactgcaagagcagaaaatttattttttaacatagcttttccttgtaaaaatcattaaatagtttgttaaaacaaaggtagatagggtaaagtgtatttctttttaacacaacctttatattttgaaatgtcagaaaatttcaataagataactacctctttggcggagttagaagctaaaatcgccttccaagatcatacaatcgaggaacttaatcaagctctgattgcccaacagtttatgctagaaaaactgcagtaccaagtgcgtcatttagctgaaaaattgcacagtgttcagccaagtaatgttgcaagtcgtgcagaagaaacaccaccaccgcactattagagtgatatttagtgattttgttcaatggataacataatgaaatttagaaattggatctattttattagcttatggctatttatatcttcgctttttgcagaagaacctacaaaaacacctctattccaagatggaaaaggctactactcttataaaaaaccattagatattttattaccgaaagataataaggtgttaattacttatttttatcagtatggttgtgaagtctgtttaaatggtgatgattatttaaaacaatactcttctcgacactcagataaagtggttttagaacgtgttgccgcttttagtgagaataaatatggcatcacagtaagtttaaatgcacttttttcagaactgggaaaacctgaattaagcgagaagtatttatttgatagctcttatcaaaatgatcgacttattaccaatgatgaagcaatagccaaatggttgcataagaatcagatttcgttggatgccgttgaacaaacaagaaaaaaggaaaattatccgaaaagaatctcacaaaattatgaattaataaaacgctattcaccgccagtcattcccatggcggtattgaatggtgaatatattttaactaaaagtactctttataatgatgattatacctacgccgtactcgactttttagtcgataaattacaaaaagagcaacaaggagtcacaaaatgaaaattggcatcataggtgcaatggcacaagaagtcgaaattttattaagttatatggcagagccgaaattaacggaaattgcaggttgtaaaatctacgaaggcaaaattaataatactgatgttgcattattgcaatcgggtattggtaaaaccgcctccgcaatgggaacggcattattattacaactggctaaacctgaaatggtgattaatacgggatctgctgggggtctagacgctaatttgaacgtaggcgatattgtcatttcaacggaagttcgtcatcacgatgtagatgtcaccgcctttggttatgaaaaaggacaactgccagctaatccagccgcctttatggcaaacgaacaacttgcacaaattgctatcaaagaaaccgagaaagcaggatttaatgcagtatctggtttaatctgtagtggcgatctgtttgtgaatggcagtgatatgattgctcgtattcgcaatgatttcccgtccgtaaaagccgtggaaatggaagccgcttctatcgcccaagtgtgtcacgcattccaagtgcctttcgttgttgtgcgtgcaatttctgatgtggcagacaaagaatctcatctctcttttgatgaattcttaccgcttgctgcagaaaaatcgtctgaaattgtgttggcaatgttgaataattttgcctaatcaaaacagcaagaggtaatttatctcgtaatatttgcaaattttaaccataaaaaaaccgcttgttgtcgaaatttatcttcaaattttgtacaattctgttcctttagcctatgctttgcataggcttgtttatttgattatctatattgttgagattgttttatgagttcagcaccaaatatcggctttgtgagccttggttgccctaaaaatttagtcgattcggaacgtattttaaccgagcttcgttcagatggttataacatcatttccagctacgaaggggcggatttagtgattgtcaatacttgtgggtttattgacagtgctgtgcaagagtctttggaaagtattggcgaagcattagaagctaacggcaaagtgattgtgacaggctgcttaggggcaaaagagaaccaaattcgtgaagttcaccctaaagtcttggaaattacaggaccacatagctatgaagcggtgatgaaacacgttcataaatatgtgcctaaaccagaatacaacccttatgtcagccttgtgccaaaacaaggcattaagctaaccccgaaacattatgcttacctgaaaatttcggaaggttgtgatcaccgttgtacattctgtattattccatcaatgcgtggtgatttagacagtcgtccaatcgtacaagtgctagatgaagcgaaacgtttagtggattctggtgtcaaagagctgttgattgtatcgcaggacacttccgcatacgctttagataagaaaaaagaagaaggcaccaaaacggttttctggaacggtatgccaatcaaaaacaacttgatcaccctctgtgaacaactaggttcaatgggtgtttgggtacgtttgcattatgtttatccgtatccacacgttgatgaccttattccgttgatggctcaagggaaacttctgccttatttggatattccattgcaacatgcaagtccaaaaatccttaaagcgatgaagcgtccaggatctattgaccgcacattagaacgcattaaaaagtggcgtgagatttgcccagatttaaccctgcgttcaacatttatcgttggtttccctggagaaacggaagaagatttccaaatgttattggatttcttaaaagaagcacaattagatcgtgtcggttgttttaaattcagccctgttgatggtgctgttgcaactgaaatggaagatcaagttccagaagaggtgaaagaagaacgcttccaccgctttatgcaattacaacaacaaatttcggcagatcgtttacaacagaaaattggcagaaccttgtcagtgattgtagatgaaattgatgaagaaggaataattggtcgctcaatggcggatgccccagagattgatggcgttgtctatgtagataacctttcaggtgcagaagtgaaagtaggtcaaattatttcagtaaccattacccaagcagatgaatatgatctgtggggaacttgttaagttttattaaggaatttgtataaattcacaatcagcgtagcttttcaatagctaactttttgagagagtggtgagatctgtttagaatttttccactctcaccctctatttatttagcacctgcaaccctcagataaggtactcaaatattaatgtaccactatagagctccttctgactcttcaaataatcagcataaatatattgtggagatgttcaaacaacgctacgatgcagatgcttcttctagtttgatttgaatgctccttactatagggttattttcttaatagttcgtatgtgaatcatggataaagtgtaacagtaaagatatttcttctaatttcaaaaaattcccaaaatttcatcgcttacacgttataatagccaacatttttgaatgaatttttaggaaaaagacaatgacagcgaaatttaacgtgaaaactttccaaggtatgattttagccctacaagattactgggcaaaccaaggttgcaccgttgttcaaccattcgatatggaagtcggcgcggggacatctcacccgatgacttgtttgcgtgcgcttggccctgagccgatggcgtttgcttacgttcagccttcacgccgtccgactgacggtcgctatggcgaaaacccgaaccgtttacaacactactatcaattccaagtggtaatcaaaccatcaccggataacattcaagaactctatttagacagcctgaaaatgttaggtttcgacccaacgcaaaacgacattcgctttgtggaagacaactgggaaaacccaacgctaggtgcgtggggcttaggttgggaagtgtggctaaacggtatggaagtgacacaatttacctacttccaacaagtgggtggtttagagtgtaaaccggtaactggcgaaattacttacggcttagagcgtttagcaatgtacattcaaggcgtggacagtgtgtacgatcttgtttggtcggacggcccacttggcaaaaccacttacggcgatgtattccaccaaaacgaagtagaacaatctacttacaactttgaatatgcaaatacggatttcttattctactgtttcgatcaatacgaaaaagaagtgcaagaattattggcattagaaaaaccgttaccgttgccagcttacgagcgtatcttaaaagccgcacatagctttaacttacttgacgctcgcaaagcgatctctgtaaccgaacgtcaacgctacattttacgcatccgcaccttaaccaaaggcgtagcggaagcctactatgcaagccgtgaagcgttagggttcccaggttgtaaaaaataattattgatagataccataagacacaacaaattttatttcataaatgtgtctaaattaaatgctgtctgtttttgcaaaacagcctgtgcaatagtgactaatttacgcattaaagccgtgataatcaccattttaggtttgccgcattcaagcaatcgcagcacaaacgagcgatatacgctgtttttgtagctgccaaaggcaaagttcattgcagggcaaaagagtgccttacgaatgtcggattgcccgatttttgaaataccaataacggtatttaaacttttccccgaacttttaatcatcggggttaaacctgcaaaagtggcggctgctttcgcgtttttaaaacgatttccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacattgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttccatcacgcagtgaaaagtttcaccaaatgtattgagccattgcataagtgattgaaatccttctggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggcaaatgacatttgcccttaaacaaaggaaaaattatgcaaaaaccagttttatatttcgcccactggtgccctgataccgccccatttgtcgctgaattacaacgtcttggtattgactacgaagaacgcgaaatgacaacaggcggtgcaaatttaaaagcttttttaaaactacgcgataaccaccctgcatttgataacgccaaagccaatggctatatcggcattcctgcgttggtgttggaagatgagaaagtggtgttggatttagctgagttacccctagcactgacgtactaggttaagcatagtattgtcgctctgcgacaagctaaacaggttgcggagcaaccgcactatgcgtaaccccatacgttagtatggggataacaagcggtataattccatagaaattttgcaaatatagataacaaaatgaacgctctccaactaacaaatgatcatttgattagcaatattgctcaaattattcatcaagcccgtagccaagttcgccagacggtgaatagtgttatggtacaaagttattgggaaattggacggttattggttgaagatgagcaacaaggtgaagatcgggcaaaatatggcaaatacgttcttcaaaatgtatctgaacgtttaactgcaatgtttggaaaagggtttgatgttactaatttgcgaaaaatgcgtcagttttaccaagcgtttccaattcgagacacgctgtgtctcgaattgagttggtcacattacagacgtttaatacaactagaaaatgcccaagcgagagcgtggtatttgcgtgaaactgttgaacaaaattggtctgtacgagccttagatcgccaaatttcggtattatattatgagcgtttactggcaagtcaaaacaaggcggtggttgctcaagaagctcaagagaaaacgcaaccattaaaagagagcattcaggattatttgcgtgatccttacatcttggattttctcaacttgcaggataaaacttatcaagagaacaatgttgagcaagcgattatcgacaatttgcaacaatttttactggaattaggcaaaggctttgcatttgttgagcgacaaaaacgcattcgttttgatgacgaggatttttatatcgaccttgtgttttataactttaagctgaaatgttttttacttatcgatctcaaaatcggtaaactgaaacatcaggatatcgggcaaatggatacttatgttcgcttgtttgacgaacaatttaaggaagagaacgataacccaaccatcggtttagtgttatgtagtgaacaaagcgaagcggtggcaaaatattcggtacttgcggatagaaaacagatttttagtgcgaagtacctgccttatttgccaacggaattggagttgaaagagcaggtggaaagggcgagagaaagattgtcttttataccttattgcgatagagagtaatctaccctatagaattctattaggaaataatcaaatgactaatattacaagtattgctgatttagctaattttttagttcaaccaactaatgcaaaattagttgaaatgactcgattttttcgtggacattcaaataaagaattcaaattagaacctagtatttatagagaaaagtatctgatacagaatgaagataaaattatcaaagatgctttaatgaattgtccgagttctttccaacccaatagtacattatttgataagttggttaccttacagcactatggctataaaacacggcttctggatataacaactaatgctctagttgcattatattttgctgtcgaatctaatccagataaggatggtgagataattatctttgatattcctacatctgaaattaaatatgattctagtgatagagttgctattttatcagcaataagtatgagaaactcgtcattttcattaacacatgctatcgaaacagcaaaagctgtcggagatgctgagcttgctacttatttagtacaaaatcatgaaaatttaaatgtagatagtgcatttcagactatagcaaactttggggagcatggtgtaacaaaagaaatgattcaaaaaagctttacagctaaaatacaagatattcgccaaaaaggggtaagaaaatcatttaatgagtatactgagattgttaaattaattcatgatataaggaatgataaacataactttgatcctataattaattataatgattttaatcaagtattatgtgtaagagctaaattagataatcaaagaattatcagacaacaaggtgcatttttattgtttggtatgcaagagtcttctaaattaactcaagctaatattactgcgtcttggattaagaacaaattagtgatcccaaaagattctaaaaattctatcttagaaagtttaaagtcgtttggtattagtaaacaaacattatttccagaattggaatctcaatcaaaggatataattgaacaatataaataatttcgtattagagaaaacaaaatgacaacacaaaacttcctcgccgagatcggcacagaagagttgccaccgaaggcactcaaaaaattagcgaccgcgtttgcggagaatgttgaagcggaattaaaccaagcgggtttgagctttgacaaagtggaatggtttgcagcacctctccgtttagcggtgaaagtattggggcttgcgactagtcagccaagcaaagaagtggaaaaacgaggtccggcggtgtcggcggcgtttgatgcggaaggtaagccgaccaaagcagcggaaggctgggcgaaaggctgtggcattaccgttgagcaggcggagcgtattgctaccgataaaggcgaaaggctggttcaccgtgcggtgattgaaggtcagccgaccaaaaacttgttagtcggtatgattagcaatgctttggcgaaattgcctatcccgaaaacaatgcgttggggcgataaaaccgagcagttcgtgcgtcctgttcacaccgtgaccttattgttaggcgatgagctgattgaaggcgaaattttaggtattgcaagcggtacgactattcgtggtcaccgtttcttaggcgagcgtgagttccaaatcagccacgccgatcaataccctgcgttgttaaaagaaaaaggctcagtggttgcggacttcaacgagcgtaaagcgttaattcttgcaaaagcccaagaaaaagcggccgctttaggtggcgtggcggatattgaagaagagttgttagacgaagtgacttctttggtggaatatccagacgtgttggcagcaaaatttgaagaacgtttccttgctgtgcctgcggaagcattggtttacacaatgaaaggcgaccaaaaatacttcccgatttacgataaagacggcaaattgctaccgcactttatctttgtgtcgaacatcaatcctgaagatccaagcaaaatcatcgaagggaacgaaaaagtggtgcgtccacgtttgaccgatgcggaattcttcttcaaaaccgacttaaaacagcgtttggaagatcagttaccacgtttagaaacagtgttgttccaacaacaacttggcaccttgcgtgacaaaaccgctcgcattgaacaacttgcaggcgaaattgcaaaacaaattggtgccgatgaaaccaaggcgaaacgtgccggcttgttgtcaaaatgtgatttaatgaccaatatggtgtttgaatttaccgatacgcaaggcgtaatgggtatgcactatgctcgtcacgatggcgaagatgaagaagtggcggtagcgttgaacgagcaatatatgccacgctttgcaggcgatgagttgccgaaatcgttggtggcaagttctgttgcgttagcggataaattcgatacgctcacaggtatttttggtatcggtcaagcgccaaaaggcagtgccgacccattcgctttacgccgtgcagcacttggtgcgttacgcattattgtagagaaaaacttaccgcttgatctgagcgatttagtggcaacttcagcgaaattgtttggcgacaagctcaccaacagcaatgttgtagaagaagtggtggactttatgctcggtcgtttccgtgcgtggtatcaagatgaaggaattgcagtggacgtaatccaagcggttcttactcgccgtccaactcgcccggcagacttcgatgctcgtgtgcgtgcggtgtcgcatttccgtacattagatagtgcagaagcattggcggcagcgaataaacgtgtgagtaacattttagcgaaagtagaaggcgaaatttcatcagaaatcgaccgtactttattagtggaaacggaagaaaaagcccttgtagaacaaataattacattacaagcagagcttgctccactgtttgaaaaaggcgaatatcaaaccgcacttgaccgcttagccggtttacgtgaagtggtggataacttcttcgataaagtgatggttaatgccgaagatccaaaacttcgccaaaaccgtcaagcaattctaaacaacttacgtaacttgttcttacaggtggcggatatttcgttactgcaataataacaaatgataaagccctattcacaaaatagggcttttttatggtggtagaatggatttagacaaattaattgagattgaccaaaagcacatttggcatccttattcatcaatgacccaacctatccctgtttatgcggtggaaagtgcaaagggcgttgaaatttaccttaaagatgggcgaatgctcattgacggtatgtcatcgtggtgggcggcactgcacggttataaccacccgcgcttaaacaacgcaatcacagaacaattagcgaaaatgagccatattatgttcggcggtatcacgcacgaacctgcggtaaaattaacggaaaaactgctgactattttaccccaatcattaaacaaaatattttttgccgatagcggttctgtggcggtagaagtggcattgaaaatggcattgcaatattggcaagcaaaaggggaagatcgaaatcaatttgccaccgtacgatcaggctattacggcgatacttggcacgcaatgtctatttgcgatcctgttacaggtatgcacggtttgtttcgtcaccgcttaccgattcaacattttttaccccaaccttcgattaaatttgatgaagaatggcaagaaagtgcgattgaaccattgaaagcattgcttgcgcataaaggaaaccaaattgcggcattgattttagaacccattgtgcagggtgccggcggaatgtatttctattcgccgatgtatttaaaacgagcgagagaactttgcgatcaacatggtgtattgctgatttttgatgaaattgccacaggttttgggcggacaggcaaactatttgctttagaatataccaatgttgtgccagatattctttgtatcggcaaagcattaactggcggttacttaacattagcggcgactattactaccgagcatattgctcataccatcagtgaaggcgaggcaaaatgctttatgcacggcccaacgtttatggggaatccactggcttgtgcggtagcctatgaatctctgtcacttttactggaaagcgattggcaacataaagtccatcaaattgaagcgcagctcaaggctgaacttgcaccggctaaagcgtttaaatccgttgctgaagtccgtgttttaggggcgatcggagtgttggaaatgcgtgaagcggtcaatatggtttctttacaaaaacgctttgtagaaaagggaatttgggttcgtccttttggtaaacttatttatattatgccgccttttattatcgaacctaaccaattaagctttttaaccgagcaattattagccgtggtcaaagaggaatatgatgaataaatttactcaatatcttcagcaattagatgaaattgggcagaaacgccaattccctgatattgaacatcagggaaaatttgttgttgctcgtggtctgacgatgttgaatttatcgtctaacgattatttgggtttggcaaatgatgcacaacaggtggaaagatttttgcaatctatcggtaaaaatcaaccgcttacgtcatcatcttctcgtttattaacgggcaacttcccgatttatcaggattttgaaacgctattagcacaacgttttcagcgagaatccgctctattatttaatagcggctatcacgccaatatcggtattttgcctgcggtggcggataaacaaaccttaattttagccgacaaattggttcatgccagtttgattgacggcattcgactttctggggcggattttttccgttataagcataatgattatcttcatcttgagcagctattgcagacacattcagagcgctaccaacaagtgattattgtcacggaaagtgtttttagtatggacggcgatattgcggatcttcaacagttagttgcactcaaaaaacgttataccaatgtgctactgtatgttgatgaagcccacgccataggtgtatacgggcagcaaggtttaggaatggcagaagtcttcgactgtattcaagagattgactttttagtggggacttttggtaaggcattggcatctatgggggcttatcttgtttgtgatagcgagataagagaatacttaatcaatacgatgcgtcctttaattttttctaccgcacttccaccgattaatgttgcttggacttactttttatttgaacaattaccgcaatttactgaaaagcgtcatcatcttgagaaattaagccaaatcttgcgaactgaagtgacgaaaagaagtgaatttccgctgctaagcgaaacttgcatcgtgccatatatcttaggcgaaaatcagcaagcggtggaaaaagccgattatttgcaaaaacaaggctattattgcttacctattcgtccaccaacagtgccaaaaggcacggctcgtctgcgtttctcattaaccgcagatttaaccgaacaagatataatgggcttaattagctgtttgtaaaaggagaaaagcgtgcgttatcaacacattacacgccaacaacgtaaattacttgtctatttttctggctggggaacgccaatcagtattgcgaaatctttagagttaccgaacgattttgatttactgatttgttacgattatcgagatttgcatcttgaatttgatttttcgggctatcaagaaatttatgtggtagcttggtctctaggcgtttgggtggctgaacgtgttttacatgctatccctttgacttacgctgtggcgatcaatggaacgggggttcctaaacacgatcaatttggtattccaacggcagtgtttgacggtacgcttgcgtctttaagcgaagaaaatcttgtaaaatttgaacgcagaatgtgcggtaaaattgccctagaaaattaccgcttgttacctgaaaagcgagatttcacagaagtaaaacaagagttagcgcacttaaatgattgtattatgcaagataatcgaacggggttgttagtgtggcaaaaagccattattggcaacaaagataaaattatcccgccacaaaatcagcttgaatactggcaaaatcaaccacaaacaaaaattcagctcattgacgcagagcattatctttttaatcacttttccggttggcaaaaactgcttgagggtgtgacgtgcagttagtggataaacagcaagtcgctatccgattttcacaagcaaaatcggaatatgataataatgcgattgctcaacaatgtatcgtacaaaagctgatggcattactcgcaacccaaggcaacgcttttggcaaaatacttgaaataggttgcggcacaggtatgttaagtgaacaacttatgtcgcattgtgagtttgaatgtttagtactaaatgatctttgtcgcgattacgagcctgctttacgcaaaaaattaccttattcttcggtacattatcacttcggcgacgcggagcgggaaaatttcggcataggttatgatttggtgatttccgcttctgcaattcaatggtttgaaaatgaagcgaacttcctgaaaaagacggctaacatactgaatgatgacggtattttattgtttaatacattttcgcctaaaaatctttatgaaattaagtatctgcttaaaacgggattaacttatcccaccgaagacgaatggtataaattattagccgatggatttgaagttcttgttttaacaatggaagaaattcccctttattttgattgtgcattatcagtactaactcatttgaataaaacaggggtaagcattattgatccgtctaaatggtcggacaatcgtctaatgcagtttgaacagcgttatcgtacgcgatttcagcaggatttaggcgttacattaacttatacgccactttatgtaatggctcgtaaaaaaaggaaacaacatgcttggtaaagtgatttttgtatcgggtattgatacggatgtaggaaaaaccattgcaacaggtttttatgctaagacattgcaggaacaaggtttttccgtgattacgcaaaaaatgattcaaaccggctgtgaaggaattgcggccgatattttagtgcatcgtaaaattcaaggcattgatttattgcctgaagataaagcaggtttaacttgcccttatgtttttccttatccttgttcgccacatttagcggcacgtttagcgcatacggaaattgatgaaaataaaattaccaatgcagtaaatcaattaagacaaaagtatgattatgttttgttagaaggggctggtggactggctgtgccttataccgaaacgagaaccaccttagattatttaaaaacacagcagtattcgctcattttggttagttcaggtaaattaggcagtattaatcacacattactcagtttgatgacgtgccaacaatatcaaattcctttagaatcactggtttataatcgttatcttgatcaagattcattgatcagtcaaaatacagaaatctatttattaaattatttacaacaacattttccgaaagcgaaatttattggtttagataaaatcgatatttaacacaacatattaagaggtaaaaaatgtcagtcaaaagtgaagtgttattcagtaatcagtgggacgtacgtatcagcgatccagggttagaaggggcaatgagccactattttgaaacggtttatttaaatctcaccgctcacattgatgcgaacaaagtcagctacgaatttacccgtaaagtcgaaaatgaagtgcaaacccattgcatttttcatagtgttgatgagctgtttaaatttttggcggaatatcttgggccagttgcgctgggtaatattggtgtaaaaattggtaagttaggtttggcttaattgtctatgagcaacttcctttaccatcaaacccaaccgtattgggactttttacgcattgaaaagcaagtaagcccccatacgctcagcaattatcaacgccaactacgagtggtttgcgaaatgttacagcaagcagaagttactcgttggcaagagcttgatgcatcgacggtacgttggattttgtcacaaagccataaacaagggttaagtgcaaaaagtattggtttacggttggtggcactacgtcagtttttggcgtttttggtgaagcaaggggaattaaaggtaaacccaaccttaggcataaaatcgcctaaagccaataagcatcttcctaaaaatattgatgcggaacagatcgggcagttgctaaatatagacagtaacgaaccgcttgatctacgagatgtggcaatgatggaattgatgtacagctctgggctacgtttgtctgaattacaagggttagatttaggcgatatggatttacctaaccgtgaagtgagattgctcggtaaaggaaacaaagaacgtattgtgcctattggttctaaagcattagatgcaattgaacagtggcttgcagtacgtgggcagtttcacccaaaagacaacgccgtttttcttaatcagcgtggtgggcgactttcccaccgctctattcagttggcgatgaaaaaatgggggcaaaagcaagcattggatacccaccttcacccccataaattacgccactctttcgcaacgcatatgttagaagcaagtcaagatttacgagcagtgcaagaactacttgggcacagtagtctttcgacaacacaaatttatacgcatcttgatttccagtatttggcgagaatttacgatttggctcatccaagagctaaaaggaacaagtattaatttagatatacattcaatactctatgatagtatacatatggagattaaggggtgaaaatgaaaaagtttgatgaactcgaagtggatgatacagaatttattgactctaaagatgcagagctagttgatattgacaataatgcttcaaatatttgtatcacaaataatatgttagtgcctcagggagcgacgctggatagttatattagaatggcaaatcaatatccagttttaacagctgagcaagagaaggagttagcggagcgcttttattatgatgaagatcttgatgctgctaagcagttaatcatgtctcatttgcgttttgttatgtatatcgctagaggttacttaggttatggattaccgttagcggatttaattcaagaagggaacattggcttaatgaaagcggtaaaacgttttaacccagagatcggtgttcgtcttgcttcttttgcggtacattgggtaaaagcagaaatacatgaatatgttttaaaaaactggcgtattgtaaaagttgctacaacaaaatctcaacgcaaactattctttaatttgcgtaaaaataagcaacgtttggcatggtttaatgaagaggaaattagaaaagtcgcagaggaattgggagtctctacagatgatgtcaaagaaatggagtctagaatggtcggacaggatataggctttgatacctctgtaggggatgatgacgatgataattatgttccctccatgtatcttgaagatgaatcttcaaattttgtagatgaattagaatatgaagagtatagcggaagggcaactgctcaattagcttatgcattagcacaactagatgaacgtagtcaaaatattattaaaactcgttggcttgatgaaaataaggctactttacacgagttagcggctcaatataatatttctgctgaaagggtaagacagttagaaaatcaggctttaaaaaaaattaaggatgtaattacttacgatataacatagtagacaaaaggcatatagaaaaaatacctagtgctttgaataaaacttggatactcaataatagggggggcactacgctatgccgaaaagctacgtccgtaaggagaggtaaggaggttaaagcatgcttcagcaattcttttatacattgagtgagatgaagctaaatgggtgagcctctcccacaatttgtgtaaataactgtttctgagataatacattcagacacaggtattttgtatggcaggcaaaatacccgcttgtaaagatgcatcaaaaaaatggacaatgccgattcagaactggaaactggcgatgaatcgatttatgattgattttggtgatcgcttagacgatcaccgttaagttgaaatgggtgtttacacagaatttgggatagggtcaatttgttataagctcctatcatatctaccactgataacctacccccacagagccgcccatttcaccactagtatttgcattaccttgtaatttaaggatcagcttgccgttgtctgacgctcttgagtaacccacagccaatgcagattgacctttgaaagtccccgctgatgctgcaatcattgacttacctgggatataaacctgtggtaaacctgctgcggcgttagaacctgcaatacccgcacgcagagctttattattacggttgatcttattgtgaatatcgcccatctgcaccttgtgctgagatattaagctatacaactggctaccattaatcgcatcggtactttgctcagagattaaaccaggtgcaacgttttgaatacggcgagtttccattttgccattactgtctacattacccacgctcaccacgcctacaacttcagttgctttaccgccggcataagcgttatacacaccacctattacttggtattctaaagcacccgctcccgcagtggttgcacctgctgccacatagcctgagtttgttcccaagaataccgagttgctggttgtattggtaatcttgttacccaatgcaaagacattttcgttctcaatcgtattattgttacccacagaataagagttatcagcattaatcacacttgggtcaccaaatgcaccggagttattgccgttcactacgttacccgtaccgatagagatagattggttgcccacagccttagcattatcaccaatagctatcgatttttcgcctgaagcaattgcaacgttaccaatagccaccgattgtatgccagctaatgtactgttaccaaatgcgaccgctctctcccctttcgcgtgagctttgtagccaactgcagtagagtatgaacctgttgcacgagactccactgtattcgacttatggttaatttgctcctctgcattatgaccatcattggtgtggaagaacctgatacgattggttaaaacataaacttgacgaccattcactgcatcagtactattcggtgaaatatcaccatcagcaataccactcagtttcacacgaggatcaactttctctttatatttctggagattgccattctcatcacgaataggttgtttagtcacagggtcccatttaacaaactcttcctcgactttctctcctgcaccagtaaggttgattgtattcttatcaccagtcattgtcgcagtgcctaaagtcacagaatttaagttcgttaaatccttgttcattttcacaacaagtttgttatctgcctcttgcgcttccacataaaggttattagccgctgagtccttaccattccatttgccttcaccctcaacggttaacttcgtacccaatggacgatgtacagtggtatcggcgttgttacccgtcaagtctaagcccgcttgtgcaatggcttgtaaatctttcactgtcgctacattatttaacgcattacccgtttgagccaataagccgcctttaccgtctttgttatcaccagcaatagctttttgtgcatctgtaggggtaagtgccgttttatttgattcagcatcatctttcaaacctaaaccacttcccacattgctcatcgcaattggtgtattgcttgcatccgatggcattgcttgaacagtaacattatttgaagcaacctcagttaatgttgcaggtgtaccatctgcatttttatatgtatttgttgcaggatcgaaaactttcccttttaagtcactctctttatagaatttaccatcttttccgcgaacaagcgtaactggtacttgtttaccatttacagtttcagtttttacttcgcctgttacagaatctttctcaaagtactcaaacggttttcgatcgttcatttcttttaagcgatcatcgacatagcccgtattcgctgcagccgttctgtctttcgccgtgccgtccggattacgttcaacatcttttaagccagtgatagagcccgtgcctttagcatccgtaccctcaccatttttagcaaagctaatttctggtgctgtgccatctgcccccgaagtaatgcttactgcatctttgccattttggcctttaagtgccaaggtgttagttgttttaccatcttgaccttctttgctagttaagacaattgcatctgcaccgtcatttcctttaaccgttacaccatctctgccataagtcgcagctgatttatccgtttgattttcgtctttcggaccaacagtcataccatctgcattgacagtatttttagagtctttatccgttgccgttacgccatctgctttaacggttgttgttaagtcattaccttctgcatctttggctttaaccgttgtgccatcaagtttataatccgcagatttcaatggttgattatttgtatctttctgaacaatgcttgtaccgtcagcacctgctgttgcagtagttactttcttatctgcaccatcaccttcagtttttgtggtcgtagtcgcatctggagtaattttcataccattagcccctgctggacccgtaggtccttgtggtcctgctggacccgtaggtccttgtggtcccactggacctgcttcaccacggtcacccttatcgccttttgctcctgcatctccttttggacctgcaggaccaggtgcaccttgtggtccaattggacctgctggaccagtttcacctctaggacctgtatctccttttggaccagcaggtcccactggacctgtatctccttttagaccctgttcacccctagcccctgctggaccttgagcaccagttggacccgcaggtcctcgtggtcctgctggacccactggaccagcttcacctttaggacctgctggcccttgttcccctctatcacctttctcaccatttttaccgtctttccctttagcaataatatcactgctgccatccgtataagtaattttcaaatcaccatttaccatttcagtctttgtaattaacttaccaatcgtagaaatcgtaatatttccgttcgtttgttctaatttaatattatttcctgcagtaaactggatcgtatttccatcctgaattgtagcttcagtgttatccgttttaatcttaaaggatgacattttagtggcaatctgagccagttgattttgaatatcaatatctaaacctataataagttttttattttgtgcagtaacgaccgtttccttatctcttccgacaacttctagtgtttcccctagcttaattgaatcagtttgagtaaagttatctcctttaaaagtaatacctttatttattttagtctctaagtcatcaatcttatcaattttgtttttagtctcattggttaatttaaccgtaatcgtatcgtccttagcatgggaagtaagaccattttctccttttaccttgagcgtaccatcccacaaccccacttttggctgatcatcactggtatcaccactaattttcatcgtcaaagatttaagctgtgccacgtttaccgcatcggtatcttgtgtaccagccgccacattgacgatttggcgtttgatgagtttattacctgagcctacaccgacagaaaccgcaccaatatcattacgatcaacctgttgtgtggatttaaagccattagcttccgatttctcatcagtaacaactgaatgagtttgttttgctccttcaataccccctttcgtttctgctctagaaccataacccaatgcaacaccaccggcaacggtaacaatcgaattgtgaccaagtgcgattgctctagtagcaccactatttacctcggcactatcaccaatcgcaaccgatctttgacctaacgcttttgcataataaccagaagccacagaacgatagcgtgcttgtgcgtttggcccaacggctacgccatcatgtccgactacttgagcactataacctatcgcaacagcaacagtatctctaccttctgcatacttaccgataacaacagaactattcccagcataactgcggaaaccaataccaataacaccgttgtcatagtgaggcgctacattagtagaaccatcttgaataaatacagctaaacctactggactaaaaaatatacctagtaatactagacttaaaagacttaatttaaatttatcttgctgtttatctaaaaaataatctgaggtgcatacttgagctcttttatccgtgtaagcggatgttttggtgtgagactttactaactcagatacaaccacccaagcctgttgagcatgactccaaataactctaaatattttattcataataagcttctctactgtttttcctaataaaacatcgtaaacctttatttacattttcaggatatacaatgcccccactccattgtaaaaaaaaaaaacaagagttacacaaaactaagaataaaataacaagaatttttcaacttttatcaataaaagctagaaataataggcggaaatctaatgaaagcggtgatttagataggatattttgcatagtagacaaaagtgttggtaaaaagtgggctaaagccttatagtacaaggctttaagctcacttttgaagaatatactcatttaaatatagaaaaaacaacaaataggttggaagggttatttaaagaactgaagcagaaattatcggttcataatggattaacgaaaaagcataagattatgtttataaaggattttttgaataaaaagagttggtaataattaggggaaataattaaaaccaacacttttgtctactatgcctaaaaaacaggctaatcatcattaacctgcgaattgatgaacacagcatagcaattttacatattaattgataataattatcgttttatttgagtgctatattttgtcaaggtataatctttcattttaaagagaaagttgtatttgcggagcttgggtagcaaaatgaggaaaaacagcaacttccgctttataccatttttgaataatctctttttggataacctctgttgcactgccacaggcttgaatgtgctgttctgccagtaaaatcagttgatctccatatagcgaggctaaattgagatcgtgcaaaatacaacagaccgttagccctttcttttggcatagatttttgagtaaacgtaggcagtgttgctgatggtaaagatcaaaggctgaggtcggttcatctaaaaatagcaatttacctcgcatatcttcactccaaagttgtaacaacgctcgagctagttgtgtgcgttgttgttcaccgccagagagctgtcgataagccttatctcgcaaagccgcacattctgtcaccgtaatcacctcttctaaatgctgatcgacttccgtttggcttcgatgatagcctcccattctaatcacctcttctacagaaaaaggaaaattgagcagactatgttgtcgcattacggcacgatgttgagccaattcagctaaagagaattgatctatacctttattatacaaacgcacttctccgctttttgccgagaggtagccagataatagacgtagcaatgtggatttgcccgcaccatttggaccgatcaacacggtcattttgccttgcggtaatactaaagagatattatctaacaaaagacgttgattaagcgttaatgtgagcctatcagcgatcagtaagcggtctgattgcaacattaatttacctccctataacgaatgactagccacagaaaataaggtgcgccaagaaaactggtaatcataccgacaggcaattccgctggagcaaatgcagttcgagcaaaggtatcagcaataagtagcaagattgctccacaaagagccgaagcaggtagaacccaacgatgatcagcacctaatttaaagcgaacaaggtgaggaatgactaaaccgataaacccaatcgcaccactcactgctacggcagagcctactaataatgccccaagtaacatcaacagtcgttttagttgtagtacattaatgccaagataatgagcttcttcatcaccgagttgtaacacattgagcttctgagcgagagtaaacaaatataaacaggcgggtaaaatcagcgtacttgcaataaataacggctgccattgtgcttgtcctaaacttcccattgtccaaagtgtaaattgacgaagttgctgatcgttactgatatatgtcagcattccgacaatagcaaaacagagtgcgttcactgcaatacctgccaataacaatttttgcatagaggcttgagtacgatgacttaaggcatagataaacccagttacagcaaggctacccataaaagcaaaaagcattgtgctataaatgccccactctgttggtaaaatatttggcaacagaatagagagggcgacagcaaggcttgccccgctatttacaccaattaatgcaggatctgccatcggattatgaaataacccctgaaataccgtgccagaaaccgcaagggctaaaccaacgataatggcgagtaaaatacgaggtaaacgaatatttaaccatatttgccacacattactgtttaggtctgctgcaattaagtcttgccacgtcaaagaaaatgcccctacatttgttgcaataagtgccacaagcagtaatacgataagtagtgagatcagccaaagggaacgggacattatttcaccacttgttcagccgcagtacgcattttttgtagctcttgccccattgttaatccgaaagcaagaaacgcaatatcatcaacaacaactaatcgcttatgttttcctgcgttggtatgtgcaagtccaggtaatgtccaaatttcatcgggagatttaaaattttccaaactcaaatggctaagcacgatcaaatcaggatttgctgaaataattccttcttgagaaatcggagcaaatctcaccgcgtctttcattgcattttttgctccaattaatcgaatagctgtatctgcgactgtaccttttccagccgccatttgatgtatgccagctcgattgagaataaataaaatattgacatcaagtggagatttattgaccgcatttatttcttgggtaaatttatctgctaaagtagccgcttgttgtggcttaccgacaatgtcaccaatgcgtttgattttttctacgacactttcaggactatatttaagcggtacgagttccacctgaatgccagcagatttcagttgttctaatacaacagacggctgtgcaacttcactcgcaatcactttagttggttttaatgccaaaataccttccgtgtttaactgtcgcatataaccaatatcgggcaatgctttcacctgtgggggattaagacttgtactatcacgcccaattaaattttgttctgcatttaaggcataaataatttcggtgacatcacccccaatactgatcacccgttcatttgtagcctgtgcagttatagaaattgcaaaacaagcggtgagaaaacagaaaaatcgaatgaatggcatataaacctcctaaatgataaaggttctcattttatattattgagaattattatcaagtgattacataccccccactcacctgcttcactacgcccaacaactccaaattcagcagctcaatcaatgcggtttctaccgccatatccgtcgctttggcaagatcatcaatgctaatcggctcaagactaatctgttcaaacaattgttgctgacaagcggtcagttcaggtagattttttgcaaatttggggtcggatttcaccgcttgtttaggtttcgtatcaaatagacttggttgaatatgcactgactgccgttgccacgcaatcgcttctaaaatatcttcaacattttcaaccagcaatgccccttctttaatcaatttatggcacccttcgctatacgggttttgtactgagttcggcaatgcaaaaacttctcgtccttgctctaacgcataacgagcagtgatgagcgagccactgttcaccgtggcttcaataaccaatgtgcctagcgataatccgctgataatacgatttcgtctagggaaattctcagcaatcggtggctggctagggaaaaattccgacactaacgcaccgcttgtttcaacgatttgttcagcaagttttttgtggcgagcagggtaaacttggtctaaaccactgcctaaaaccgcaatagtaatcccgttttcattggccgcacgctgatgacaaaatccgtctatgcctatggctaaaccactggtgacagcaagttgatgtttcactaattccgccgaaaaatgccctgcccagtgttcgccatagtgggagtaatctcgactgccgacgatagctatctgcggtaacgataaactttcaacattcccacgcacaaaaagcacagggggcgcagtactgatctgcttcaataaaaaaggataatcttcgtcaaataaggttaaaatctgttgctgatcctgttctgcccattgtaacgcctgatcaatccatttatgctcaggattaaaccaacgctgaatttgccgttcattccagcccatttgctttaatgcggttttgtcatattgacaaaattcgccaaagtccacttccgagagtaaccgcccgatacgttgcgcgccaagctgtggcacttgtaacagggctaataattttgtgagatgtgtcattttcgtcaaaatcctaccgcttgtttactttaactttttctttgttggaggtagaaaattttcatcgttgattacagatttccctgtcttagtttccaacgcttctctcgcatttttagcaattttgccaccttgtttacttgcttctgcattttcatctacaccttgagcctgctttacttccgcaatttgacgggtagataattcagctaatgctgtgaaaagtaattctgcttcagtcatatgatcgcgtaggttttgactatctaaccctttgagttccttgtgcttttgaatactaagcccagcccattcttgatgaataatgtttgtaagaaaagcaaactcttgaggttgttcaacgccagaagacttccaatagtcagtaagtttgttacgggtttcctgccccatcattctttgttggatccatttatcacttcgccccattttttgccaatgttctcttgctcgatcaaggctttgtgcagggtcgtgaatttcttgtaaacgctcataaccaactcttgctagccattgtttaaaaggctctgctttagcactaggaatggactgaataaggcggaaaagttgttccacatcagccacatctgtcattcgcatttttccgtctgccgatctcattttcaacccgtgacaatttgtcacggtttcattaccttctgcttttaggcgttgttttaactttcgccaataggcatttggatctatgctttcggttaaaatagcaattacatcaataatagagaaataccatttttcttgttgtgtatcatagtgactacgcacagaatgttgttcaaaaagttttatatcttccatatttcgcctaaaactgtataaaatatcaggttatcatagacctatttttgtacaggtcaatactgtataaaaagagtttttctatttttcgatgagattcacaaaatattaaaaatcctattttccaccttatttaccacctaaatttccctaatcctaataaaaagtttaaaatagccaacatattctttttaatttttcgacggagatcgcaaaaatggctgttttagacgttttaatttacccagatgagaatttggctaaggtttgccaacccgtagaaacggtggacgcagaactaaatacctttattgataatatgtttgacacaatgtatgaacacgaggggatcgggcttgctgcaccgcaagtcaatgtgcttaaacgtgtgattactattgatattgaaggggataaaactaatcaaatcgtgttgattaaccctgagattttggaaagcagtggcgaaacgggtattgaagaagggtgtttgtctattcctggttgtcgagctttagtgccacgcaaagagaaattgacagttaaagcgttaaatcgtgaaggtcaaacgtttacgcttgaagcagatggtttgttagccatttgtattcagcacgaaatcgatcacttaaatggtgtgttgtttgtggatcatatttcccaacttaaacgccaacgtatcaaagaaaaaatgctcaaactgaaaaaacagattgagcgtgcgaaataaaggagaagacaatgattattgtaacaggaggtgctggctttatcggtagcaatattgttaaggcgttaaatgcaatcggtagaaccgatattttagtggtagataacctgaaaaatggtgagaagtttgttaatttagtcgatttagacattgcagattattgtgataaagaagattttattgcatctattattgcaggcgatgattttggtgagattgatgcgattttccacgagggggcttgttcagcaacgacggagtgggacggtaaatacttaatgcaaaataactatgagtattctaaagagttgttgcatttctgtttagatcgccaaattcctttcttttatgcgtcaagtgcggcgacctacggcggtcgttcggacaactttattgaagagagaaaatttgaacagccgttaaatgtttatggctattctaaatttttgtttgatgaatatgtgcgtaaaattttgcctgaggcagagtcgccagtgtgtggctttaagtatttcaatgtgtatggtccacgcgaacagcataaaggctcgatggcaagtgtggcgttccatttgaatacgcaaattcttaaaggcgaaaatccgaaactatttgaaggttcggaaacatttttgcgtgattttgtgtatgtggaagatgtcgctcaggtgaatatttgggcgtggcaaaatggtatttcgggaattttcaatctaggttcgggcaatgcggagtctttccgtgccgttgctgatgcggtgctggcgttccatcaaaaagggcaaattgaaactattccattcccagatcatttaaaatctcgttaccaaacctttacccaagctgatttaaccaaactgcgtgcggcaggttatgataagccgtttaaaaccgttgcagaggggactaaggcttatatggagtggttgaatagataaaatgtaagcggtaagattgagctgaaatcttaccgctttgtcttttagatgtagtgagttccattaaaatcccaaatggagaaggtattttatgaaatataatctcatcgcattttctttgcttgcattacctttagtagctaaagcaaacccaacttgggtagatcatcaacgaataaaattacaagaacagcttgccagcattaaaacagcatttgagtgtcgtatttggtgatgaagatttagataaccacgctcaggatcaaaatcagttgcagcgtaattatcgatcactattaagtagacataaaaagtatgatagtaaacagatacgaaatgataatgcgtctttagcattacgttggtctaaaggtgttaaagcattagggattgatactgatgtggatttagggattcgttctgggacagacatattcttacgtttcaaagtagctaaaacctggcaacacaatgaggtattttctacccgattagagtaaatttatcgatatggtataaaaagtaaacactaccttcgtactaattttgaaaataaattccagtggaagcctcaggtttttatcaataatcatacctttctacaatatacccgtgatttagatgagaatgttgaatggggtaatagtttgtatcgtcagcacgattttgcgggctataaaaaattgagctatggtttatttgttggcggtaacatcaataagaaaaaagcggctctaactcactacggacctttcatcaactggcagcaaccaatttggaaagactgagtgtttattcagcctgaagtccatttttacaatgataaaaaacaaaatcgtaaacaccatttcggcgctttttacgactggaagcgattttctaacatcttttttaggcaaacaaagtaataatattacaaatagtgaaaatagcataatcagacgattaaatattatctaactatttactatcccgacaatattcttgtaaatttaattaatatcttatttatagtaataatctattcttgtggtcttgccagctttttatagaaaaaaggtagactaattctgttatgcaatccattccactcagaaagcgattattagaaggctatttttgttagattggtttacgttgagatacgtgtagaaacttgagttggcggaggcgtatgggagttgaacccacccgagaacgctggcatcctcaacaggatttgaagtcctgccacatcaccggatatgacacacctccgaaaaagtggcactattctactgaatttattagaattgtgcaaaatttctgacggatctctgctatgcaatcactatttcgttcaattcctgcaattgataaactgctaaaaacatcacaaggtgctgatttaattcaacaattcggacatcaagcctttgttgctcaagctcgtttactgattgaacaagctcgccaacatattcagcaacatcaaagtctgcctgactttctacaaacagaacatacgctttttaacgaattaactcaccgcttgcaaagccttgctcaagttaaaatgaaacctgtgtttaacctgacaggaacggttttgcataccaatcttggtcgtggcttgtggtcggaacaagcgatttcagctgctaccagtgcaatgcgaaataacgtggcgttggagtttgatattgaagcaggtaaacgcagtcatcgtgatctctatgtttctgagctgttacaacaactgacaggggcggaagcggcttgcgtggtcaataataatgccgcagccgtattgctaatgttggcgacttttgctcaaggcaaagaagtgattatctctcgtggtgaattaattgagatcggcggtgctttccgtatccctgacattatggctcaagcagggtgcaagttggttgaagtgggtacaacaaatcgcacccatttaaaagattatcgcaacgcaatcaacgaaaataccgcatttttaatgaaagttcacaccagtaattaccaaattcaaggttttacttcaagtgtgagtgaagaagagttagtggcattagggcaagagtttaatctgcctgtgattagcgatttaggcagtggctcgctcaccgatatgcaagccctaaacctacctgccgagccgataatgcaacaaaaagtcgcttcaggtgtggatttagtttcgttttcaggggataaactacttggcggtccacaagctgggattattgttgggaaaaaagcctttatcgatcaacttcaacagcacccactcaaacgcgttttgcgttgtgataaagtgattttgtcaggcttagaagctacgttacgccactatcttttccctgatcgtttaacggacgagctaccgacattgcacttgctaacacaatcccttgattgcttgcaacacaaggcagaacgtttaaaagtagcattaagtaagcggttagattatcgttatcttttgcaaattgaaccgagtgaagctcaaatcggcagtggggcgttaccgacagaaaaaatcccatcgcttgccgtgactatttcggcagacaaacagagcgatttacttgaattagaaaaacagtttaaaacctatccaaacccgattattgctcgttttgcacaacaaaaaatgtggctagatgtgcgaagtgtggcggagtttgaggtgcttatttttatgttggaggaactatgatcatcgtcaccgcaggacacgtcgatcacggcaaaacatcacttttatacgccttaacgggcactcacaccgctcacttgccagaagagaaaaaacgggggctgacgattgatcttggctatgcttatttgccgattgaaaatgatattttgggttttattgatgttccaggccaccaaaaatttctgtctaatatgctggcaggtcttggcggtgtccaacacgctttgttggtgatatcttcagaagaagggattaaaccacagactgaagaacaccttgctattcttcgcctgttgaattttaagcagattattgtcgtactcaccaaagcggacagagcagaagctactcgtataacccagctgatcgaacaattaaaacagcgttatccgtttttagcttcagcacatttctttgtgacttcggctcagacaggcgagggcattaagccgttaaagcactatctgatcagccttaatcaccaaagcacacaaatagataaaccgttccgctatgcgattgaccgtgtatttaatgtgaaaggtgcaggtttggtagtgacggggactgcagtcgctgggaaagtggctatcggtgatgaattttatctctcaagcggtcagaaagtgcggataaaaaacattcacgctcaaaataacgaagcatcgatcggggtagcagggcaacgtttagccttaaatatcgccaatgtggaaaaagagcagattgaacgtggcgactggattacacagcaggatccccaatttgcttgtgaccgcattaccgttcgcctaacgacagcccaagctttaaaagaaaacagtgttgtgcatctctatcactttgccagtcacactaccgcaaaattaaatttactagatggaagccaatgccttgctgatgataccgcgatagctgaactgattttagatacaccgttgcacattgctttagaagacaaacttattttgcgtagtggcgacgacagtcaaacccttgctggtgcggaagtgatcgaaattcactcgccgaaacgccataaacgtagcgaagcacgcttgagttatctctcacagttagctaactgcacaagctatcaagaacgtattgcactctatctgcaacataaagcggtgaatttgacccaactactgtgggcagagcagatttttattcgtgatttagaaaaactggcggaaaaatcggattactatctcaactctaatcacctgtttaacggggcatttaaaactcagatccagcaacacattgtggcgaagctcgaagagtatcaccaacagcatagcgatcagcttggggtgacaaaggctcgtttacatcgtattgctacgttagagttatcagaacaacttgcctttgccctcattgacgaactgattgccgataacactttggcacaaacacgcggttggatccataccccaacacatcgcattgagttcaatgatgccgaattgcaaatttgggcagaaatccgaccgctatttgaacgaaccaatcaagccttatgggttagagatattgcttccgaactgtccatagatgaaactgaaatgcgtgacttgctatataaagcagggaagttgggctatttagtgccgattgtcaaagaccgtttcctattacacgaacagatcagtgcatttgctcagcttatcaaaaatttcattgaacaacatggcgaaatttcggtaaatcagcttagagatgaaattcaatatgggcgtaaagtgaccgtgcaactgatcgaatacttcgaccgttcaggcttcttacgccgtaaggggaatgttcatttgttgagggatagggatacttattaggagctatagagagtactaccatgcacggagacgaggaataaaatctgagaattttatgatgtgaggctaaaaacttggcgtagtagtctcctcaattggttcatgatgatacgtggattgcttgttacacgtaatgtaaaataatttgagcgaattgatagcttaaattagtaagattaaattttgttcattgtcttgaggtgcatctgaaaaattccaaattgttttgagaaacttcgatcttaaaatttacagagaagctggttcccctctttagcaaagaggggttaggggagatttggcagaacatacggcgaagtgagagaataaattagatataagacatataagtgcatatttaggtttgtcagcggtctgcccccgatggaaacatcggattttgcatttaggaggataagagtttttatagacaaagccagcgttctatttttgcaatagattgtccacagaatagtccgttttaagcaaatcaaccaaatttacgtctaaagcgtccgcaattttccccattgcatcaattgaaatcgctctttttcctcgttctacatcactaatataagctcgactaagttctgcatcaaaagcaagagcttcttgagaaatatcctttaatcggcggatttttctaagattattcgcaaaagtatggcggattggatggctagtaagatgttcatttttcatctttttagtattgattctagcactatattcatcaatctacttaaagatataaaacataaactatagtttatattattataattttagattaatatatgatcgcaaaaattgatttatagatgaattttgcaagggcgtatgctctttttaataatatcgtttaatttctctagaaggattcttataatgaaactctcaattacaaagaaaactgtattaatagttgcaatgttaagtgcagttacaacaacatatgcggcaatgggctttttaattagagaagaagtaagtggaacaaataaaatttgttactatgatgtactaggatcaactcgtactatcaatgttccatcgtattctgtatgcccagtatcacataatttctaatagttttatggcgttcactttgaatgccattttttttaataattaagtttttcaaaatttattgagtttcttcttgttgccaaaaaaacaccaaattgctataatccgcaatccgaatttcgcatactggctagatgaattttcgtctagccattttgtgcttgaataacattagctaaatttgcgtcgttttagtttggctaattaattgatttataagatgttgttatgaatttatagatcgcaagcggtcgctttcgtgcaaaattgtgcaaagaccgttcccccctgagctaacctctgcggtagtgatttttgaccctttgtgtgaactcagaaaacgacacctcgtatcattttttataatgccacttcctgccggtcttgaggcggattgtgaaaactcaaccaaacagaaaatcagaggctatatttaatggcatactcatattccgagaaaaagcgtattcgtaagagctttggcaaacgctcacaagttctgaacgtaccttatctattaacaattcagctcgattcttttgataaatttatccaaagagatcctgaaggacttcaaggtttagaagcggcattccgttcagtgtttccgattgtgagcagcaacggtgcaactgaattacaatacgtttcttacgaattaggcgaacccgtatttgatgtgcgtgaatgccaaattcgtggtacaacctatgcagcgcctttacgcgtaaaacttcgtcttgtgacctttgatcgcgaagcggcagcaggcacagtaaaagacatcaaagaacaaaacgtctatatgggcgaaatcccattgatgaccgacaacggtactttcgtgatcaacggtactgagcgtgttatcgtttctcagttacaccgtagtccaggcgtattcttcgattctgacaaaggtaaaacccacgcttcaggtaaagtgctttataacgcacgcatcattccttaccgtggttcttggttagatttcgagttcgatccgaaagacaacctttatgcacgtatcgaccgtcgccgtaaattaccggcaacaattattctgcgtgcattaggctacaccaccgaagaaatcttaaatatgttcttcgaaactgcgactttccacattgaagacaacagattattgatgaccttagtacctgagcgtcttcgtggtgaaaccgcagctttcgacattgaagcaaacggcaaaatctatgttgaaagtggtcgtcgtattaccgctcgtcacattcgtgcattagaaaaagacaatattactcaaatccaagtgccgaccgagtatatcgtaggtcgtgtgacagcgagagattacgttgatctttcaacaggtgaaattgtttgcccagcaaacagcgagatcggtttagaaacccttgcagcattagcacaagcaggttacaacgagatcgaagtattatttactaacgatcttgattacggtccgtacatttctgaaaccttgcgtatcgatccaacttacgaccgtttaagtgcgttagtggaaatctatcgtatgatgcgtccaggtgagccaccaacaaaagaagcggctgaagcattatttgacaatatgttcttctcaaccgaccgctatgatctttctgcggtaggtcgtatgaagttcaaccgttctttagatattcctgaaggcgtaggcacaggtatcttaagcaacgacgacatcattggtgtaatgaagaaattgatcgaaatccgtaacggtcgtggtgaagtcgatgatattgaccacttaggtaaccgtcgtatccgctcagtgggcgagatggcggaaaaccaattccgtatcggtttagtgcgtgttgaacgtgcggtgcgtgagcgtctttcattaggcgatttagatggcgtgaccccacaagatttaatcaatgcgaaaccaatttctgcggcagtgaaagagttcttcggttcatcacaactttcgcaatttatggaccaaaacaacccgctttcagaagtcacccacaaacgtcgtatttcagcgttaggttcgggcggtttaactcgtgaacgtgcaggctttgaagtgcgtgacgtacacaccactcactatggtcgcttatgtccgattgaaaccccagagggtccaaacatcggtttgattaactcgctttctgtatatgcacgtaccaacaactacggcttcttagaaaccccattccgtaaagtcgtgaatggtcaagtgactgaagagatcgaatacttatcagcgattgaagaaggtgcttacgttatcgcacaggcgaactcaaacttagatgagaacttccgctttaccgatacttatgtgacctgtcgtggtgaacacggtgagtccggtttatatcgcccggaagaaattcactatatggacgtttcaacgcaacaagtggtttctgtggcggcagcattaattccattccttgaacacgacgatgcgaaccgtgcgttaatgggtgcaaacatgcaacgtcaagcagttccaacattgcgtgcggacaaaccattagtcggtacaggtatggaaaaaccaatcgcccttgactctggtgttgcggtgattgcaaaacgtggtggtactatccagtacgttgatgcttctcgtatcgtagtaaaagtcaatgaagatgaaaccgttgcaggtgaagcaggtattgatatttataacttaatcaaatatacccgatcaaaccaaaacacttgtatcaaccaaattccttgtgtgaaattaggtgagccggttggtcgtggtgaaattcttgcagacggtccttcaacagatttaggtgagttggcgttaggtcaaaatatccgtgtggcatttatgccttggaacggctataacttcgaagactcaatgttagtatctgaacgtgtagtacaagaagaccgctttactacaatccacattcaagagttatcttgtgtggctcgtgataccaaacttggtgcagaagagatcacggcagatattccaaacgtgggtgagtcagcattaagcaaactggacgaatcaggtatcgtgtatatcggtgctgaagtgaaaggtggcgatattcttgtgggtaaagtgacaccaaaaggtgaaacccaattaatcccggaagaaaaattactccgtgcgatcttcggtgaaaaagcatcagatgttaaagatagttcgcttcgtgtaccaaacggcacatcaggtaccgttatcgacgttcaagtctttacccgtgatggcgtagaaaaagacaaacgtgcgaaagacattgaagaaattcaattacgtgaagcgaaaaaagacttaaccgaagagttagagatcttagaagctggtttattcactcgtgttcgcaacttattagtagaaggtggcataagcgaagcagaattagataaagtggctcgtgagaaatggttagagcaaactttagaagatgaagcaaaacaaaatcagttagaacagcttgctgaacaacacgaagagttacgcaaagagttcgaacgtaaacttgagatcaaacgtaacaagatcattcaaggggacgatttagcaccgggcgtattaaaagtagttaaagtttaccttgcggtgaaacgtcaaattcaacctggggataaaatggcaggtcgtcacggtaacaaaggggttatctcaaaaattaacccagttgaagatatgccgtatgacgaaaacggtcagccggttgagatcgtattaaacccattgggcgttccatctcgtatgaacatcggtcagatccttgaaactcacttaggtctggcagctcgtggtatcggtgaccaaatcgacaagatgatcaagcaacagcaagagattgcgaagttacgcgaatatatccaaaaagcctatgacttaggtcacggagcgcaaagcgtagatttaagcaccttctctgatgaagaagtgatgcgtttagcacaaaacttacgcaaaggcttaccgcttgcaacaccggtatttgacggtgcacacgaaagcgagatcaaaggcttattagaattaggtggattaccgacatcaggtcaaattactttatatgatggacgtaccggtgagaaatttgagcgtccggtaaccgtaggttatatgtatatgctcaaattgaaccacttagttgatgacaaaatgcacgctcgttcaacaggttcttatagtcttgttacccaacaaccactcggtggtaaagcacagctcggtggtcagcgtttcggtgagatggaggtatgggcattagaagcatacggtgccgcttacaccttacaagaaatgctcacggtgaaatcggacgacgtaaacggtcgtacgaagatgtacaaaaacatcgtggacggtacacactatatggaaccgggtattccagagtcattcaacgtaatcacgaaagaaatccgtgcattagcgattgatatggagttggatgaagcgtaagaacgacaatttgtagggacgcactgcgtgcgtccgtggacacactcagtgtgtccctacattcgttcccacaagcggtcaaatcttgcaaacaatttgccaacaccgaccgcttgcaaccaaagattttcagttgaaatgggcgaccatttcaagaacaaaaacctcaaatcaggggcaaaaacgtgaaagacttagttaagtttttaaaagcacaatctaaatcgaacgacgatttcgatgtgattaaaatcggtttagcatcaccagacaaaatccgttcttggtcgtttggtgaagtcaaaaaaccagaaaccatcaactaccgtacattcaaacctgaacgtgacggtcttttctgtgcgcgtattttcgggccggtaaaagattacgaatgtctttgtggtaaatacaaacgcttaaaacaccgtggtgtgatttgtgaaaaatgtggcgttgaagtcacccaaaccaaagttcgccgtgaccgtatgggacacattgaactggcttgcccggtggcacacatttggttcttaaaatcacttccgtcccgtatcggcttaatccttgatatgccgttgcgtgatattgaacgtgtgctttattttgaaagctatgtcgtgatcgaaccgggtatgacggatttagagaaaaatcagttattaaccgaagaacagttcttagacgcagaagagcgttggggcgacgagtttgaagcgaaaatgggtgcagaaggtatccaagcgttactcaaagacttagatttagaacatcaatgtgaaatgttgcgtgaagagttacaagaaaccaactcagaaaccaaacgcaaaaaaatcactaaacacttaaaattacttgaagcattcattcaatcaggcaacaaacctgaatggatggtaatgacggtattaccggttcttccaccggatcttcgtccattagttccgcttgatggcggtcgttttgcgacatctgatctgaacgatttatatcgccgtgttattaaccgtaacaaccgtttaaaacgtcttttagacttaatcgcaccggatattatcgtgcgtaacgaaaaacgtatgttacaagaatcggttgatgcgttattagataacggtcgtcgtggtcgtgcaattacgggttctaacaaacgtccattaaaatcacttgcggacatgatcaaaggtaaacaaggtcgtttccgtcaaaacttattaggtaaacgtgtagattactccggtcgttcagtaatcaccgtaggtccatacctacgcttacaccaatgtggtttaccgaaaaaaatggcgttggaattattccgtccgtttatctactctaaattagaaagccgtggcattgcttcaacgatcaaagcggcgaagaaaatggtagagcgtgaagatccgattgtatgggatattcttgctgaagttatccgtgaacacccgatcctgcttaaccgtgcaccaacacttcaccgtttgggtatccaagcgtttgaaccgttgttgattgaaggtaaagcgatccagttacacccacttgtgtgtgcggcgttcaacgcggacttcgacggtgaccaaatggcggtacacgttccattaacgcttgaagcacagttagaagcacgtgcgttaatgatgtctaccaacaacgtactttcaccggcaaacggtgatccgattatcgtaccatctcaggacgttgtattaggtctttactatatgacccgtgagaaagtaaacggtaaaggcgaaggaatgtacttccttgaccctcgtgaagcagaaaaagcataccgtacaggtcaagcggaattacactctcgtgttaaagtgcgtattactgaatatgagaaaaacgcaagcggtgagtttgaagcaacaaccagcttagtcgataccactatcggtcgtgcaatcctatggatgatttcaccaaaaggtatgccgtttaaactgttcaaccaaactttaggcaaaaaagcgatttcaaaattaatcaacgaaagctaccgccgtttaggtttgaaagaatcagttgtattcgctgaccaaattatgtacacaggttttgcatatgcggcacgttccggttcatctgttggtattgatgatatggtgattccagcacagaaatacgaaattatttcagctgctgaagaagaagttgcagaaatccaagagcagttcaactcaggtcttgtaaccgcaggtgagcgttataacaaagtgatcgatatttgggcggctgcaaacgaacgtgttgcgaaagcgatgatggaaaacttatcaacggaagaagtattaaaccgtgaaggtaatccggaaaaacaagcatcatttaacagcatctttatgatggcagactctggtgcgcgtggttctgcagcacagattcgtcagttagcaggtatgcgtggcttgatggctcgtccagacggttcgatcatcgaaaccccaattaccgcaaacttccgtgaaggcttgaacgttcttcaatactttatttcaacccacggtgcgcgtaaaggtcttgcggataccgcattaaaaacagcaaactcaggttacttaacccgtcgtttagttgatgtggcacaagacttagtgatcgtagaagacgactgtggtacacacgaaggtatcgtgatgaccccacttatcgaaggtggtgacgtaaaagaagcattgcgtgatcgtgtattaggtcgtgtggtagctgaagatgtcttaaaaccaggttcagaagaagtgttaatcccacgtaacaccctaattgatgaaaaatggtgtgatgtgattgaccgtgaatctgttgatgtgatcaaagtgcgctcagtcgtaacctgtaacacagacttcggcgtgtgtgcgaaatgttacggtcgtgaccttgctcgtggtcacttaatcaaccaaggtgaagcgatcggtgttattgcggcacaatcaatcggtgaaccgggtacacagttaacgatgcgtacattccatatcggtggtgcggcatctgcagctgcaaaagaatctagcattcaagtgaaaaatgcaggaacgatcaaacttaccaatgcgaaatcggttacaaacaaagacggcaagttagtactaacttctcgtaacaccgaattaactgtggttgatgcgttcggtcgaactaaagagaactataaagtgccttacggtgcggtgctttcaaaagcagatggtgcagaagtgaatgcaggcgaagtggttgctaactgggatccacatacaatgccaatcatctctgaagtaagcggtttcatcaagttcagcgacattgtcgatggcttaaccgtaacacgtcaaaccgatgaactcacaggtctttcatctgtggtagtacaagatgtgggtgagcgtgcaacggcaggtaaagatttacgtccagcattaaaattagtcgatgcacaaggcaacgatattttaatcgcaggtaccgatgttgcagcacaatacttcttaccaggtaaagcaattgttaccttaaacgacggtgcagaaatctctgtgggtgaggcattagcgcgtattccacaagaatccacagcgactaaggatattacgggtggtcttccacgcgttgcagacttatttgaagctcgtaaaccgaaagagccagcaatccttgcggaaatttcaggtatcgtttcatttggtaaagaaactaaaggaaaacgccgcttgttaattactccagcagagggcgaaacacacgaggaaatgattccgaaatggcgtcagctcaatgtgtttgaaggcgaaatggtacaacgtggtgatgtgatctctgacggtgcggaaacgccacacgacatcttacgcttacgtggtgttcacgcagtaactgaatacatcgtaaacgaagtgcaagaagtttaccgcttacaaggggtaaaaattaacgacaagcacatcgaagtgatcgtacgtcaaatgttacgtaaagcggtaattaccaacgcttacgactctgagttcttagaaggcgaacaagtggaagtggcacgtgtgaaaatcgctaaccgcaaacgtgttgctgaaggcaaaccagaagtggaatttgaacgtgaattgcttggtattaccaaagcatcacttgcaacagaatcattcatttctgcagcatcgttccaagaaaccactcgtgtgcttaccgaagcagctgtggcaggtaaacgtgacgaattacgcggcttaaaagagaacgttatcgttggtcgtttaatcccagcgggtactggttttgcatatcataaagaacgtgcaaaacgccgtagcctagatgaagaaatcagcgtagcacaagcggctgtttctgcttcttcttttgcaactgaggaagacatcgaagctgaaacccaaagctttgttaatgacgaagcaactcaaaaccttgcagcattactaaatgcagggtttgatagtgatgatgaagagtagtcacttataggtggggtttgccccaccgttgttaaaatgaaaaagccctcagaactgtgaagttttgagggctttttgatgcagatagttttacattatgaagagcaatttgtattgttcaataaaagatatttttcttagaatggaaagtcaaacgtacccaaagaaagcatttacataaaaatacaggcatagtagacaaatttgtctactatgctcatagtgagaaactctctaaaggattgaagcattattgaacatttttatagtatttaagtatcctacctacataaattgcatttttccgtctttgataaaaaatgaagtggcattgtcctgtcttttcccttgtattggttttagctgttcttgggtaattgcagtaacaaaaacttgtgaaccgctttgatacagtcgatcagccagtaattcgcatttttgagtgtcaagttcagaggcaaagtcatcaattaaaaagatacattgacgatttttttgagcaataaaatactctccttgcgcaagccgtaaggcacacatcaataatttaagttgccctctagaaagtacgtcttctactggtaatccgttagctcggaagcgaaaatccgctttttgaggaccgaccatagtatatccaacggatctgtctctttcaaagccttgtgctaaaagatcggcgtaatctctctctttttcccacccttgatagaaagttgctgtaatttctaattcaggtaaaaagaattggcagtttttttcaatgtaggtaagaatagattcggcatagacagccctagattggctaactatttgtgcaaatttgctaagctcgacatcccatggctttagttcattataatgacgagtttgtacaagggctgcatttcgttgttttagtagtcgttttaggctattccaattatgatagaagtcagtattttgatggaacaacccccaatctaggaatgctctgcgatatattggtcctccattgagcaatgttaaaccttcaggggtaataacctgcattggaagaagataggctaggtcagcgatctttttattactttccccattgattcttaatatagtttctccttgacgatttttttgtaaaccgacagagcattcgtgtttttcttcttggattttgccaaataaagtgaattcttcttggttgtacttaatgattcgattactaatatgacttttaaaggatttaccgtgaccaaggtagaaaattgcttcaagtaggctggtttttccacttccatttgctccaataaaaaagttaaagccgtggttcagctcaagatccacagctgttaaatttcggaaattattaataattaaacgagatagggacatgcaaagattacttttaaatcacataataatctatgtattagtttattgagttagtaatggataatcccaccaaatatcaaacaaattactcacttcgatttcaactaagccattagcttctaaccatttttgcactaattgacggtgagattcatcacatttacctaatttttctaagcaaattaaaccttcccaatgcaaatagccgctgccttcataagctaagccatttgggcgaattacttcatcaatgaaacgatcaacagttgtatcaatttggtcaataccagtaccttctacaaattggaatttcactaaaaagcctaattcttggaactctgctaagtgcatttttttacgctgtctgcgattacgaattggttgagccattttctttctcctatttgagtaacattatttcttaataaaatataaatcccacacaccgtgtcctaacttatgtccacgttcttcaaacttagttaaaggacggaaatcagggcgagggataaaatcgttggtttctgatgtattttgcaatgaagcatcaaattgacgtaatacttctagcatatgctcggcgtagttttcccagtctgtcgcaaaatggataaaaccattcggcgacagtttggttaatacacgggtaacaaattcaggttgaacaatacggcgtttatggtgtttcgctttttgccacggatcagggaaataaagctgcaatccacctaatgatccatcagcaatactatctcgcaaaatctctgtcgcatcgtggcagatcactcgcagatttttcacgcctttttccaacgcataagcgatacaagcaccaacccctggtgtgtggacttcaatcccaatatagttgcgatcaggattttgttctgccatttccacgagtgaacgccccataccgaagccaatttcaagcactacaggattgccgttgccaaaaattgcctcaaaatcaaaaggcgtattttggtaatctaaaccgagattttcccagttattattcatcatatcacgttgataatcgctcaaacgccctgtacgcaacacaaaactacgcactttacgaagatagcgaccatctgcagtaaattcagcacgttcaacggttttacgttttttatcggcaaaagtaattttttcagacattttaatgttcgccgattaaaatctaacaagggcagaaccccaagtccaaccgccaccaaaggcttcaagaagcaatagttgcccacgtttaatacgcccgtcacgcaccgcttcatctaaggctacgggaatggttgcagcactagtgttgccataacgatctaaggtgatcacaacctgttccatatccatctctaattttttcgctgttgcactaataatgcgtaaatttgcttgatgtggtacaagccaatctaactgagctttttccaaattatttgcggttaaagtttcttctaccacatcagaaagctgcttcacggctaatttaaaggtttcgttcccttgcatttcaatatagccagattgcttatcgccacgttgagcataaggcaacactaacatctcatttttttcaggggaagcgtgtaaatgcgtagaaataataccctgttcagtacttgcttctaaaataactgcacctgcaccgtcaccaaataagatcactgtgctacgatctgtttcatctaaattacgcgagttaagatccgaaccgatcactaaggcttttttcacttgtcctgtacgaacgaactgatctgcaacacttaatgcgtaaacaaatccagtacaagcggcggctacatcaaaagcaattgcatcttcaatgcctaacaaaccttgaatttgacaggcagcacttggataagcgtgagaattactggttgttcccaccacaattaaattgatctcttgcagatcgatattggcctgttccaaacatttcttagctgcttcaaagcccattgttgcaacagtttcatcggctgcagcaatgcgacgttctttgatacctgagcgagtaacaatccactcatctgaggtttctaccattttttctaaatcagcatttgtacgaacttgggtgggcatatagcttcccgtcgctaaaattttgctgtacatatttttttctcaacttttctagattgctagatattataactataaccctctaaaaatagtaggggataggagcgattataaaggtaaatcattctcgacaatccgcaaaaaatcactaaaatcataccgcttatatcaaaaggaaattcaatgaaactcaatcctcaacaacaacaagcggtagaatatgtcaatggggcttgccttgtgctggcgggtgctggttcgggcaagacacgggtgatcatcaataaaattgctcatctgattgcccgttgcggttattcgccgaagcagattgcggcggtgacttttaccaataaagctgcccgtgaaatgcgtgagcgtgtggcacattctatcggtaaggaaagtagtcgaggattgacgatttcaacctttcacacccttggttttgagattttaaaacgtgaacataaattactcggctataagtcggggatgacgctgtttgacgaacacgatcagctggcgttgttgaaacatctgttgcctgaaaatgtgacggaagataaagatctgttgaaattgttggtggcgaccatttctaactggaaaaacgatctgcttttgcccgaacagacgattgtcttagcaaaaagcgatcgtgatcgggcgttcagccatttttacgatcaatatcaaaatcagctcaaagcctacaatgctttggattttgatgatttaattatgttgccgactttgctgtttaagcaatttcctgaagctaaagagcgttggcagcagaaaatccgttatttgttggtggacgaatatcaagacaccaacaccagccaatatgaattgattaagctgttggtcggttgtgatggcaattttaccgtggtaggcgatgacgatcagtcgatctactcgtggcgtggggcaaagcctgaaaatatggggcggctgcaacaggattttccgaagctcaaagtgattaaactcgagcaaaattaccgctctagtcaacggattttgcactgtgccaacattctgattgataacaacgatcacttgtttgataaacgcctcttttcgcagttgggcgaaggcgaaaagctcaatgtgattgaagcaaaaaatgaagaacaagaagctgaacgtattgtgggtgagttgattgcacaccgtttttcacgcaaaaccaagtataaagattatgcaattttatatcgtggcaatcatcaatctcgcttgttggaaaagttgctgatccaaaaccgtattccctacaaaatctcaggcggaacgtctttctttgccaaagccgaaatcaaggatatgttggcctatctgcggttattggtgaaccaagatgacgatgcggcatttttacgcattgtgaatacgccgaaacgggaaatcggggcggcgacgcttgaaaaattagggcaacttgccaatgaaaaacaggtgagcctatttgaagctatttttgattttgaactgatccaacatttaaccccaaaaccgtatcaagccttgcaggactttgctcgctgggtggtggaattatccgatcaagcggtcagatccgagccgaaatctgcaattcaggatatgttggcgaaaattcaatatgaagcctatctctacgaaacggcagcaaccccgaaatccgcagaaatgcaaagtcgcaatgtgcaaacactgtttgaatgggtggagaaaatgttggaaggcgatgaactcagcgagccgatgagcttaaatcaagtcgtcaccaatttgactttaagagatatgatggaacgtggcgaagatgatgacgaaagcgatcaggtgcaactgatgacattacacgcctctaaagggttggaatttccacacgttttcttgatcggtatggaagaaggcattttgccacaccaaaccagtattgatgaagataatgtggaagaagagcgtcgtttggcttatgttggcattacccgtgcacaacagacgcttactttctctttatgcaaagaacgccgtcaatacggtgaagtgattaaacccgaaatcagccgatttttactcgaattaccgcaagatgatttgcaatgggaacgagataaacctaaactgagtgagcaagaacgccaacaaaaagtatctgctggactgaatagcttaatggctatggtacaagcgaataggaaatagaatacttcatgttatcgaacaatttgtattaatggtgaaatatcatcgtttacaaagatttctttttcagccattgaggctatttgttcgtgggaatattttttggcgttgtatacaacaactatgcttgtatctccaatatgtaaaaagtgattttttccaaaatctgtgtaacacgttgctccgatactaataattgctttattgggataatctgcttttttaattagttcagatatattattcattggatcttgattgggttggttgttcattctatcaatgatccaagctaacaatttctgatggaaatagctatagctaataactggactatctaccccatattccgaaagtttgccatcacgtttatgaaaacaggcaatgtggtagctatctaaatttcccccctgttcaaatttatctaatgcaatttgtgcagaagaaataccttttgaatgggctccccaatttttcttttcgcaaattttacgggcatcaggccggcgaattgaacaatcattataggctgcaaaatgtgttggttttaatgcaatcacacgaccttctttatattcaatatcacaaattaatgcaacttcaggttcaatttggagattatctgctttctcaggaaaaacaatgatatcgtgagagagagggtatgttgaaagaaattgttcatttttgtctagatgttcgctaggaacataaaagggaaaaatagcttttggttgatgaacttcgctagtttgaattttcacaaaatccctatcctctccagcttgttctaaatgcccagtaaaattaccagcaacgcccagtccaatgaatttagaattttccatacctaatctccaagaaattcaatatatgtaaatattattttactgattttatacagaaataacgataggtattgtaactatttgttattcaggtagttctttttaatacctattaatatgatacatatgtttttgtcaattgtatttgtttttcaataagttagcattatactccaaagattttaacatcggaatcccatagtgttcaaatatcaatgtacgggaatatttcgtatcaatgataattcaatatcaatttttcttaagagagtcaatcaatgaaaaaatgatattgagagtggttaataaccatcaaacaaaagacattgttttgaacggtgctaaaacggctgttcaaaaagcagagaaaggaacaaaataccaactagtagatgaacatggaaatttaattactaatgctaaagcggaagttgttggaaacgatcttgctatttcggtagaaggaagtcagcaacctagtttagtgttacaagattatcaactacattatcctatagaaaatgcacaatatttagcaaatactcaagcctcatttgctacagcagaaagtgccgcagctgcagctgagatttcggcggttgcttccacaagtatcgcatcaacattaagcacagcacaactggttggtcttagttcaggtgcggtaactgcggcaacagctggcgttgtatcagaaacagttagaaaccatacgagtaaatcgtcttcatcctcaaaatcatcaatgcaatcaaatcatgttgagaatagtgtaccccaaattactctagatcagattaccaatgataaccttattgattatatagaatctcaacaggaaaaaattacgatcactgggtctgtgactaatgcaaataacggtgatattgttacgttgaaagtaggggaagcagtatcaactggtctggttacagatggacgttttgcgattgaagttaccgcaaaagataagatggataacccagcaaaagctcctgtagaaaaagaatatcaagttgatacgattgcacctgaagtcaaactcggccttgaacctattgcaggcgataatgcaattagcagcgatgaacgttcgggcaatattacgatttcaggtagtgatgctcaggcaggacaaaccgtaaaaataatggtaaatagccaagaaaaatcggcagttgtagatagcaatttaaaattcaaacttgaagttccagcaagcgatcttattgcgaccgataaatatgtggtaaaagcaagtgttacaggcaataacaatgcttctgccaatactgctcgtgcttatagtgtcgataaagaagtcgttgctcaaattgatattaagaaagtgggcgacttttcgttaaatatgggcgaaattgaaccgcttgtacgcattaaaggcaatgttgagttcactgatgtctatgctgtgggtttaaatcacaaacgcttgcttgaagtgaaagtgaagtttggcgataaagtttataaggctggtttccacgataaacagttcttccttgatattcctgcaagtgaattagctgaattaaccgggaaggacgtttcattatcgttttctttagcaacaggcgttaagggtgactaccataacaatatttatgggctaaccaaaaaagatgatggttcctatgcgacttggatcagttatggtacaagaacacctgcagtgaaaacagtaactttcgacagtccacatttagaaagacaatctgataccagctacaaagcaaattacaaagcagaacaacaggttgaggtaagcggaactgttacagcagcggcgaatagctctgtgaaagtcggtgatactgttgtggtcaaagtaggtgaaaagagctatgaaaccaaagtgcaagcgggtaataccttctcgacaatggttgataaaaaagccttggtccaaacggataaagtaacagcaacattaacaactaaagacttggctgaaaaagagatccaagtaactgatgtagagagagttgtaacaccaagtaatataagcagtaagcacgttattgtacaaaatcaaccaccgaaagagattaataatgatcactctactgatggctataatttcccttattttattgaaaaagtgcaagatgatcattcacaagcgggttggagcacggcttattttgtcaaacgtttaggtggatttggtctgagctacaatgtaccggcaggttcaccgcaagagaaacctgcggtgattaaatattatttccacggttcagagcaattggagtttgaaacaggcggaagtgttccaagcgatgcgttacaagatacgagattgaaagagatttttagagaggtttatgatcaatactcaagctatcttaacgttgaatttgtggaaagtaaggtggttcctgttacagatagacaaagtttagtgattaattttggcaaaatgacgaacggttctgctgctgtggcaatgagcgggggaaatatcacttggaatgcagcaaatgattataagagctggggcgaggattacagttattacaccgcattacacgaaataggccataccttaggaatgccgcatactgattccacaacagaatttggtaaagactatttgattgaagacagttctgagttttcagtgatgtcttataaccgttatgtaaacaatagcttatatcagaagttacattctttgcgaatgtatgatttagcctatttacaaaatcgttttggtgtgaatgcgaaatctcgtgctggagatgatgtttatacctttgctgattttaatacttacgcctccgatggtggtcgttatatttgggatggcgcagggattgatacctttgacgcatctaaagagcaagcaggggtctatgttaatttaaatccaggctcttggatttatgttggtgagacaaaagagaaaaatttcttgattaaaagcgttcacagtagtaagcaggacgtaaaaatatactttggcttacctgataaagcaacagtggatagtaatggggctgtgaatgcgcctctagatatttctgatgtcgaatatacaaaaggtcaagcctatatcggacaaggtacacaaattgaaaatctacttggttccgcacatagcgacactttaatcggtaatgccgcagacaataatatttacggcggagcgggtgatgatacattaattggcggggaaggtgaggatacttttgttttcaatgctagtttgaatggtaaggcagatgttattaccgatttcagtgctgaagataaaattgaattatccaaaacgatctttagtagtttaacaagtgcagataaagtgatagaacatattcaatatgattcatcaacagggaaattaagctacgatagtgatggaagcggaaaaggcaatgcgattcattttgcaacactttcgacatcatcgcttttcacagtagagagcaatgtatttattattgcttgatgtattgtgaaaaagtaatgaaaatcgcccgcttgtcgctaaaaattcactcaaactgaatttcttttcaccaagcggacattttttttcaaattttttgcaaaaaagtacttgcgttggttttgaatttctctataatgcacaccacacaacgacgcgctgttgtgagtagttaaatttgacagtgcgtcgttcttttttgctctttaacaatttatcagacaatctgtgtgggcacttgttgattgactttgtttaaaaatatttttttaattttgaagtcttgataggtgcttaacttgaaattcataatgattgaataaattcagtcgtgatttttttatagtcagtacatattgagcgattaaactttttaaattgaagagtttgatcatggctcagattgaacgctggcggcaggcttaacacatgcaagtcgaacggtagcaggaaggaagcttgctttctttgctgacgagtggcggacgggtgagtaatgcttggggatctggcttatggagggggataacgatgggaaactgtcgctaataccgcgtaatgtctaaggactagagggtgggactttcgggccacctgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaagggtgatgttttaatagagcattacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggtggctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagctttcagagatgagagtgtgccttcgggaacttagagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggtgcatacagagggcgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaactgaaagggggcgtttaccacggtatgattcatgactggggtgaagtcgtaacaaggtaaccgtaggggaacctgcggttggatcacctccttacctgaatgaagagatttgcaagtgttcacacagattgtttggtaattgtagacaaggaatagagcaagaaaacagacacaagcggtcagatttgcgataaaatttgcaaattgacaggatgaaggaaagcatctttaaatgttgtccccatcgtctagaggcctaggacatcgccctttcacggcggtaaccggggttcgaatccccgtggggacgccatttaaagatgattttttgtcgaaagataagtgattatcgaatgttctttaaaaatttggaaacaagctgaaaactgagagattttctgtaggggcaaatcacatttgccctgaaacaagaaagtctgagtagtaagaaaaatcttgactgaacaaaagcagtcaagtgtttagtagttaatatcaacttcaagtgaaaatgtttgaggttgtatggttaagtgactaagcgtacacggtggatgcctaggcaatcagaggcgaagaaggacgtgctaatctgcgaaaagcttggatgagttgataagaagcgtttaatccaagatatccgaatggggaaacccagtagatgaagaatctactatcaatagatgaatacatagtctgttgaggcaaaccgggagaactgaaacatctaagtaccccgaggaaaagaaatcaaccgagattttgtcagtagcggcgagcgaaagcgaaagagccagcaagtgatagcagcaaagacagaagaattggctgggaagccaagcgacacagggtgatagccccgtattttaagtttttgttgtggtactaaacttgcaacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcccgaaagggtgactgcgtaccttttgtataatgggtcagcgacttatattttgtagcgaggttaactgaataagggagccgaagggaaaccgagtcttaactgggcggctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttatgtgaataccttcgggggtagagcactgtttcggctaggggtccatcccggattaccaacccgatgcaaactgcgaataccgaagagtaatgcataggagacacacagtgggtgctaacgtccatcgtggagagggaaacaacccagaccgccagctaaggtcccaaagtctatattaagtgggaaacgaagtgggaaggcttagacagctaggatgttggcttagaagcagccaccatttaaagaaagcgtaatagctcactagtcgagtcggcctgcgcggaagatgtaacggggctaaaatatagcaccgaagctgcggcatcaggcgtatcacaaatacgccttacgattaacaacatcgaatgaagtgaaacggaataagatgttggtcaagcacccaacacgttgagttggcataaagtgcggatagaaatcagaggaatatttgtgatacgtctgttgggtaggggagcgttgtgtaagtcgatgaaggtgtattgagaagtatgctggagatatcacaagtgcgaatgctgacataagtaacgataaaacgagtgaaaaactcgttcgccggaagaccaagggttcctgtccaacgttaatcggggcagggtgagtcggcccctaaggcgaggctgaaaagcgtagtcgatgggaaacgggttaatattcccgtacttggtaaagctgcgatgtggggacggagaaggttaggttagcagactgttggatgtctgtttaagttggtaggtggggagtttaggcaaatccggacttccataacactgagagatgatgacgagtttctacggaaatgaagtaactgataccacgcttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgctggcgtaggttgtaagagtatacctccgaaggctgaaccagtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagactaagaagcaggcacgccagtgcttgtggagtcgtccttgaaataccaccctttaacgtttgatgttctaacgaagattacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacattcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgtaccagttgtctcgccagaggcattgctgggtagctaaatgcggaagagataagtgctgaaagcatctaagcacgaaactcgccttaagatgagttctccctagctataagctagtaagggttgttgaagactacgacgtagataggtctggtgtgtaagcggtgtgagccgttgagctaacagatactaattgcccgagaggcttaactatacaacctcaagcgtttttgaagtagacgtgagagagttagagagctgaatataagcggtggaatttggggagaaatttgtaaatcacgatattatgctgatgcaatacaaaattatccgtagataccataagacacaacaaattttatttcataaatgtgtctaaattaaatgctgtctgtttttgcaaaacagcctgtgcaatagtgactaatttacgcattaaagccgtgataatcaccattttaggtttgccgcattcaagcaatcgcagcacaaacgagcgatatacgctgtttttgtagctgccaaaggcaaagttcattgcagggcaaaagagtgccttacgaatgtcggattgcccgatttttgaaataccaataacggtatttaaacttttccccgaacttttaatcatcggggttaaacctgcaaaagtggcggctgctttcgcgtttttaaaacgatttccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacattgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttccatcacgcagtgaaaagtttcaccaaatgtattgagccattgcataagtgattgaaatccttctggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggcaaattacatttgcccttaaagaacagaaaaaagaagatagagagaatcatcaaaagattttcccgacgacaatagtgcagttgtcccacctgattccataccgaactcagaagtgaaaagctgtaacgtcgatggtagtgtggggattccccatgtgagagtagagcatcgtcggggttttattaacttagttcattaaattagtgaactaacttaataaaagaatttcttggcaacaatagtgcagttgtcccacctgactccataccgaactcagaagtgaaacgcagttacgccgatggtagtgtggggattccccatgtgagagtagggcaccatcagggcattaatttaaaccctagtagagatactggggtttttgctttttgttcgggaaaacaaaactaagggattttaacccaattaatctttttcaagtttataaaagcgtggtggaaaaaattgagttttttcgttgaatttgacttcataatgtagatatttctacaattatgttataattttgttaattattaaccaatataaggaatttatgtgtcagcccagaagcttattagtacactcactcaaattgtgggggagaaatatattattactgaagcctccaaaacagaagtttatcgaagtggttatcgttttggatcaggaaatgcacttgccgttgtacgtccagcgacattactagagttttgggaaatattaaaggcttgtgttgcagctgatgttatagtgattacccaagctgcaaatacggggttgacagggggttcgacaccgaatggcgatgattatgatcgggatatcgtgattattaatgcaatgagaatcaatggaattcaacttattaataatgcgagtcaggttgtgtgtttgcctggttctactcttaatgctctagagaatgcattaaaacctcacaatagagaagcacattctgtaataggctcatcatgtattggtgcatcggttattggtggtgtttgcaataattcgggaggggctttagtacaacgaggaccggcttataccgaaatggcactttatgctcaattaaatgaaaaaggtgaattagaacttaaaaatcacttagggattgatttaggtgaaacacctgaagagattttacaaaatctacaagaacagcgttatcaacgtaaggatattcaactagaatgtggaaaaggacatgatcatgcttactgtaatcatgttcgtcaaatagacgaagattcacccgctcgttttaatgctgatccggctcgtcattatgaagcatccggaagtgcagggaagttagctatttttgctgtacgtttagatacttttcctgcagaaaaagaaacggctgtattttatattggaacaaatcgaactgaagttcttaatgatattcgccgttatatgctagctaattttcagcagttaccaatttcaggagaatatattcatcgtgatgcttttgatatggctgcagaatatggtaaagatacattttgggtaattaaaaagctgggtactcatcgtttaccaatgttattcgcactaaaagcgagagtagaccgtttagctaaaaaatatcattttttacctaaccatttgagtgataaagcattacaattaatttctaaagtattaccacagcatttacctttaagtcttcgtcaatatcgagataaatatgaacatcatttaatcgttaaaatgggggggggaggtgttacagaagcaagagaatatttaaaaacctacttcgcagaaagtgctaaaggtggttatttcgaatgtaattcggaagaaactcaagcggcaatgcttcacagatttgctgttgcttctgcggcagtacgttacagagctattcatgaaaaagaggtagaggatattgttgctttagatattgcgttgcgccgcaatgatagtgaatggtttgaagtattaccaacagagatcaacgataaaattagccataaactctattacggtcattttatgtgccatgtttttcatcaggattatattgtgaaaaaaggtcatgactgcgtagcattagagcataaaatgttagaattgcttgaccaacgtggtgcccagtatcctgctgagcataatgtaggacatttgtatgaagcaaaacctactttacgtaaattctatcaacatcttgatccaacaaatagttttaacccaggtatcggacaaacttcaaagaaaaaatattggcaatagctgagatatattcgaagatttagtacaagattgatataacaacctgtgtttcttgtttgatacaggttgtttttatttggcatagtagacaaaagtgttggtaaaaagtgacttaaagccttatactacaaggctttaagccctcattttgattcttgctgacaacctctaactcattgattccattatgattatattttgaaatccaacgacatagcgttgtgtctttgagttgaaattgccgatgagtgagagatcgatttttgccattttgaggataaaactcgattacttgttgtttgaatagtttgttatatttggtcataaaaaatctacacattaatcagttggttgtttagtccaactttttgagtgcagattacttttttataaccttaaaaaataggtgtaatagacaaatttgttgctaaaaagtggcttaaagccttatagtataaggctttaagctcatttttttgaggtatgaacaaaaactgcccattttgccaaagtctgaaaataaagaaacatggtacatcaaataatattcaacgatatttttgtcataaatgccataaaaccttttccttcaaaaataaattagacccaattaaaatttggactgattacacatccggaaaacaaacctatcaacaacttgctattaaatatcattgttcagtcagaacgattcaaagatatatcaataaagcccctaaaacagctttaaaactacctttaaatcgatacttgaacatcattatggatacaacattcttcgggcgttattttggtgtattagtgctaatggattctaattcaaataacgtcattgcccattattttgtccgaaccgaaaaagatatttactacaaacttgctctaaataggttaagagaaaaaggctatataattcaatcaattaccttcgatggttggagtggtttgatgaaagatttatttaatacgccagcacagatgtgtcaatttcatatggtggagattatgatgcgaaaattaagaaaaaagcatcaatcgcaactatatgagatagcatattcattaaaactgacatagtaaaaatggttgctatgcctgaaatttagggctaacttacatcagcccctaaattcgtgtggagatgtggggtactgactatttttgcatagaaagaaagaaaaaatttgggctgaaaaatgcggtggggctttgtgtgatggggcttaccgcattttttgttggggggagttatgcaaaaagtaaaatgggcaaaaatgggcaaaaatggttgaaaatgggcagtttttgcaatattttttgcatagaccctatcccaaattctgtgtaaacacccatttcaacttaacggtgatcgtctaagcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcagtcagattttcgcgagcctgtgcttccgtcggggcttgataaacctgctttaaatctgcggtgacggctttgtaatctttccacgaaacgaatttcaagctgttacgcactaaatgcacaatgcaaagctgaatcttcgttttaggatagactgtattgatggcttccgggaagccttttaaaccgtctacacaggcaataaaaatgtctttcaagcctcgattttgaagctctgtcagcacattcgcccagaacttcgcaccctcattttcagcaatccaaagccccaataactcttcccttggcatataaggcaataatctgctcatccattcctgtgatgcgggtttggtttttcttgataagttgcggttcaaaggtgccgtcacggtcacgaggcgtctcaatttctatctcaccttcatcacaaatgacggtcttcgatgtgtaaccgttacgtgcatttttaccttttctaggctgatgtttttcataaccaagatggtcggtcagctcaccatttaacgcagcctcgatggtgatttgcttgagcatccgtgaaaattgattgaggtcttctggtgtttttaggtttttggcaaattccgcttccaaggcgtaaagttgtttttcgttcataataaaatacctgtgtctgaatgtattatctcagaaacaggtatttacacaaattgtgggagaggctcctttgtcatataggcatagtttttacaaaattagcaaccattttgtctactatgccaaataattggggagtttttacattaattagcccgtctctgttgcaataaccaatttaatacttctggactattaaatacagcatcccatgtattatgcggattattattaataattccattatctccttctttctctgtgctaaattctgtatatttaacataaggagcatttagttctttagtaagtatttgataattaattctagagccttttactggagaaactttatcttccttactgtgaaaaaaccaaatcggtatatttttaattggagataaattctctttagttgcattaccatctatccattcaattgtataggcctctctacctcccattaaaagcgctcctgcaaagaaatctggacgctttaataacaaatatagcccgccttctgcaccacgagataatcccgtaatataaattctattgggatctatcatcggataagatttcaatgtattgtcaatcattttaaacaagaggttatgacgattatcagtttgccaatgaatcccccctttactacctgtagaataattatcaaaagaatcaaaaacactatcgtattgaggtgctaagacaaacccatcttcatactgtaaagtagctatagctcctttacttgatagtaaatgagcaatattgtcttttcctacttgtcctgaaccatgtaagaagatggttagaggatatttttctttatttaaggaagagggaatatgtaatctataattcaatttattttttggatcgtcgatagtaactgttccttccacaaaactatctgtgtctgtttttaaattaccccgaagaatcgtttctgtccattgttctttatctaatgttttaccattagttaactttaaaaaacctgtttgttctatattatatgatagcctttctccatagaatactggtactcttattgcctgttttttctcattagggatgatattaccttgaatatccttttctctaaataacataggagtatcattttctactttaatttcgtataaatctgaacccttatctctaacatccatctcaataataataaatttaccttgttttgatttaaaggaaacatcaggttgatcatttacatatgcttttaaaataaccctatctttaagaggttttccatccaaatatggtgttactttatataattgtgacaaatcacttcctgataagatattatcttcatactttaaagcaagagcttttattttttgacctttagctgtagtttctgctagaaaagttatatctactttttctgatactttttgaggttgatcatctatcccataagcatgggatacacaaaatagacctaataaagcatataaagttttcattttttcctcctaaacaaaacaggctgtaaatatggtatttacagcctattcttaataattaaagatgtttattttgagctttgatatataagccaatacctatcataaccacaacaggaagaacgagatcgaatagtgagccatcattaccccaaattaagttagccaagatgacactaataccgccaataccccaagcaattgtagttggtacagaccagacgatcatttgttttttcacatcattgatgcccatcattcggtttacaacccagaataaactatcgttgaaatatccaaagaaaagtgaacccattgttgctgcctgtgcggcaaggatcatattcacaccagggatctgagctagaattggagcagaaattgatgcagctgtaatcattgcaacagtaccggaaccttgaataaaacgaaccagtgttgaaacaataaatggaattaagataggagaaatcggtaaattcgcaatttgctctgcaagctgagctcctgcaccactctcacgtaaaactgtacctaaagcaccgccagcacctgttacgagtagaataatacctgcagttttaacaccttcctctagatgtaatgcagttgtagtcttgtctgcatgcggaagtaacgtataaacagcaactaagacgctgatagctaaagcaatcattggatgtccaacaaaagcaaatacatcataaagagccatttctgcaatcgtaggatttgattttgccactaaatctaaaatagctttaataaagattagtacgattggcaatacaattgggagaagagataaacctaagcttggtaaattctttttctcacgactttcaatatagtcatcgtatttttgttttagctcttctttactaaatacttcttggttaaattcaggatattttttatctagccattttgcatataaaacaataccgataacaggtaatactgccatagccataccaaccaaaagcattacaccaatatctaccccaaataatcctgctacgcctaatgggcccggtgttggcggaacggtatggtgagttacaaccaaaccacccgctaaagctacacctaaagttaataaagaacgtttaccattttttgctaaagcttttgcaactggatataaaataacgaaggctgaatcaacgaaaatagggatactaactacataacctgtgatagctaaagcccactcttcttttttcttacctaacattttgatgaagctatatgccattttttctgctgccccagaaacttcaagcacacttcccatcataacccctaaaccgatgacaataccaataccacctaaagtaccgccaaaacctttactaattgccccaagagtctcatttaccgtcataccgccgattaaacctgctatcgcggatgcaataagcatcgcaataaatgcatgaacacgtgtcttaagaactaaatagactaaaacaaaaaccgcaatgattagcccaatgataggaatcggtagtccaaacataatgttttctcctacatatcatattgaataaattgttgaatcacgtctttaaaatcattatcagcagtaaaacctaattgaagagcataagtattgtctatttcagcaggccaacttgcgacaatattgttaatgtttgcatcaaaatcaaaacggactttttctagaataggctctcctttcacttgaactaaatcagataacatctgtttcacactcacggtaaaacctggaagattaatcacatgccaatgacgtggtggaagggatgtcaatgtcatcgcatgaatgaaattattgattaccgtatttgggcttgataaccataaacgtagatcttgtgacactggacaaatcgcttcttcgtcatgcaatggctcacggataatactgctcacaaaagaagaggctgctttgttcggttttcctggtctaatacaaattgttggtaaacgaacgacaataccatctacaaatcctttacgactgtaatcattaattagcaactcacacattgctttttgtgtaccgtaagtagattgcggagtaacagcagttccattaacaattacatctggtaactcaccaccaaaaacagctaaagaactagagaatataaaacgtacagcaggattatttttacggcagatttccaataaattccttgttgcaaggaaattaatttcataacctaaatctggatcctgttccgcatggctactcacaattgcagctaaatgaaaaatagcatctgtttcttttgtaataatttgatctaatccttctggatttcttaaatccatctctaaacaacgaactcttgaatcaccatttggagcaatcggttttactacatcaattaacacaagctcatcaattttctctgaatgctgatttaataaagtacgagcaagtctttgacctaaaaaaccttgtccacctgtaattactactttcatttctttctctttcatctaaatagattaacgatttttgtatggttgaaaccattgcaagccatcaaccgtatttgctcttggtttgtattcacaacctacatagccttcataaccgatttcatctaatttgttgaaaatataagcataattaatttcaccttcatctggctcatgtctatctggtacagatgcaatttggacatgagcaaatttgctatccaacttatctgtcaatcgagataaattgccatccacgttctgggcatgaaaataatctagctgaacaaatacattttctctctgcacagcttctacaatttccaaggtgtcaaattgactttttaacagatagttaggtttaacttctggacttaacgcttctaacaatactttaatgccataaggtttgaatttatccgccgcataacgcacattctcaatgaatgtttgtttatatgcttctctatcctgatcttctggcacaactgctgccatgacatgtacattttcacaacctagcgctaaagcatactcaagagccatatcaatatccttatggctatcttcctctcgccctggtattgccgaaacaccccattcaccggcagacacattacccgcagcagtgttaaataaaacttgtttcagctcatattggtctaataagcgctttaatacctctttgtcatattcataaggccataaatactcaacatatctaaatcctgctttggcagcagcttcaaatctgtctaaaaaaggtacttcattgaacatcatcgttaaatttgcagcaaatttaggcatttttatttccccctattttctagatccttcacttcactctcagagaggtagcgaatacttttcccttgcaaaataaaatgtaattttgcagtttcttctaactcttccgtgttatccaccgcatccactaaactgtgtcctgttactacaacaccatggttggcaagtagaaaagctttagcctgtaatgctctttcactcaactcccttgcgatattgatatcaccaggcttgtaataagggatcactgcaagttgtccaactctcataacatagtatggtgtaaaagctctcatcgcatttgtagtatctattccttccaaacaagataaggctgtgagataagttgaatgtaaatgaactatcgctttacactgaggatttgcttgataaagtgctaagtgaaatacagactctttggaaggtttatcaccctcaatgagatttcccttcatatctaaaacagataaacgattaacttctagtcgtcctaaagatgaacctgtaggtgtgacaagcaccctattatcatcaagtttgacggaaagatttccagcaccacctactgtgtatcctcgatcaaataacgactttgcaagttcaaccatttggattttttgtgccaaatccgtcatacaaacatctcctgagcgaatttaaagaaatcctcttttccaaagttacctgatttcaatgctaaataaatcggttcttctaccgcttttagccaaggaacccctggtgcaatttgtttaccaatatggaaaccggaaaaacctagttgctgaaccacaatgctcgatgtttctcctccagccgtaataaaattagtgatgcctgtatctttaagtttttctgccaaacgagcaaaggtagtttcgatggcatgactcgctttctctgcaccaaattgggcttggattgtttttaatgtttcaggagggactgttgcatataccattggagcaagcggttggtttaggtgagaaatcacccattggtagagctgtgctacatattcaggattattgatagcttgttcagcatctaagaaatagctaggtgcatgtttctgataatacccaacttgcttattagtcatcacagaacaagatcctgataaaataacggttttcgccttggttggcgtaaaggcatcagtaccttttttaccacctgaaattctttcagccatatatgcagccaacccggagccacccgtcaccaatttaaaactttcaatcgattctgctaaaacagctaactgagtattgtccactgaatcaactacagcatatcgatagccttgttgttttaactccataaaacgttgtttaacatagtcagcacctttgaataattcagcacagcttactaaaccggttttctcacgtgcctgcatatccattaaacgaacaaggttggcatctttcattggtgtaatagggtgattttgcatacccgattcattaagtaatacatttccaacaaagagataaccattaaaaatggtccgcccattgattggtaacgcaggacaaataattgtgaaatcctcacccaatgcatcaagtaatgcatctgtaacaggacctatattgcccttctctgtgctatcaaaagtagaacaatatttaaaatagaactgttttccgccattattttgtaaccatttcaacgcatctaatgattgctcaatcgcctcattaactggattcgagcgtgatttcaaactaataactacagcatcaacaggttctactaaatttgatgttggcacaccattcatctgaatggtctttaatccattttcaactaaaaaactggcaatatcgcttgccccagtgaaatcatctgcaataacgcctaacattttatttatctcccttttttggtaactcaataccatcaaagatcttaatcactgcactatcatcttctttgccatacccagcattacttgccgatgtaaacatattgaatgctgtacttgctaaaggaagtgggaatttcaatgctttcgcggtatcagtgacaagtccaagatcttttacaaaaatatcaaccattgataatggtgtgtaatctccatcaacaacatgtttcatgcgattttcaaacatccaagaattacctgcagcatttgtcaccacgtcatacatcaaatccaaaggaattcccgctcttgctgctaatgccatcgcctcagcgcctgctgcaatatgaacaccagctaataattgatggatgattttgactgtagctccaagtccaatttcttcaccaatgttataaacttttcctgcaaccgcatctaacacaggctctaatttctcaaaagcttctttagaaccagatgccatcactgtcatatcaccattagctgctttagcagctccacctgaaacaggtgcatctaacattaataaccctaattctgttaatttatgtgaaatttctttagcatcttgagccgaaatggtagatgaaaccattacaaccgtacctttatttaggtgagaagctaatccattttctccaaataaaattgatttcacttgagtagcattcacgacaagtagtaatacagcatctaatttagatgcaaaaggaatagcgttctctccaatgtcagttgcaccaaaggattttaatgtttctaatgctttagaattcagatcaataccataggtatctaatccttttgtaatacaagacttagccgcccccattcccattgcaccaagcccaattactgcgatactataagtagatttactcataactaactcctcataaaatgatgtctcataaattatgtttacaaatcatacataacaataaaaataaaatctgtgacaaagctcacaaaatttaacaaaattgttaaattttgttaatagctcaaggtaacatagatgggtataatgaacaggccgaagataatgtaaggaaagaatatgattccagcagaaagacaaagacagattattcaaattgttaatagttttggcagtacaagcgttaattttcttgccaaccgtttaaatgtctcacatatgactatccgccgagatattcaaaaattggaagaagaagggaaaatatcatcagtatcagggggggttcaatcacttgagagactgacgacggaacccacgcatagtgataaatctcaattatttcacgaccaaaaatgggcaattggtgttgcagcagcaaaacagattcctcataatgccacgatttaccttgatgcaggaacaactacactagaaattgcacatcaaatagcagaacgcaatgacatcttagttatcactaatgattttgttatcgctcattttcttagtaactcaggtcgatgtgaaatcattcacattggtggaagtgtctgtaaagaaaatttatctacaacaggcatgcttgccgcacaattcttaaaaaacttatctattgatatcgcatttatctcgacttcatcatggaatcttaaaggactcaccacgcctaatgaaaacaaaattcctgtgaaactagcaattatagaagcctctcgtaaaaatattcttgtcactgattcttctaaatatggaaaatttgcgactttttttgtatatcctctcaccgtatttgaccagatcatttgcgataaaggattactagaaaatgcccaagaatctattagcagtatgaatgttaatttattattagtctaagttacactaatttaaaatatttcgttatttacctatttttgcaaatttatggcaaaatcagaccgcttgtattgaggaggttttatggcaaaagtctatattgttcacggttatactgcatcggcggataaacattggtttccgtggttagaacaagaattagcaaaaatcggggttgagtgttatcgcttgaatatgccagattcaagtaacccaaatccagataaatggctgagacatttggaaggacacatcaccattgatgatgagactatcgttgtcggacatagtttaggctgtatcgcttggcttaactttttggcgagaaactttttaaaacctaaagcggctatttttgtgtcaggattttatcagccattggatacgattcctgaactgagttcgttttcaaatagttatgctgttgcaccaagctgtttagcatttaagtcttatgttgttgccgcgttagatgatacggttgtcccacatccatatagtgatgaattagccaaacatttgaaagcagattatattcgcttaccgtcaggtgggcattttttagatagggaaggatggtgtgaatttcctcttctgatcgatttaatcaaaaaacagatagaatgaaagagaaaaggcgagaattattctcgcctatgttctattttaagccttcctgaacacgtacagcatctacacctttatccgcttcgacacgttcgataaaggacttgaagtgagtgaggtggctaacatccaatccaacacgtttcgcccagcctaacatggtgtagagatacacatctgtgacacagagacgttcaccgaaaaaggcgtggtgctctaagtgatcgttggcaatttctaacattcttaacatattgtccgccgcattttgacgaatttctaccgttaaagcttcatttccttgtgcataaggtggtacacgaaaaaacggagtaaatgctttatggacatctgagttgaagaatgacaaccaacgcattgccttggctttgtcttgtgctgtatcgctaccaaacagtttcgcttcaggatgaaggctatcaaggtaggttaagattgcaatgttttgtgatagtgcaaaatcaccatcaactaataatggcacagcaccttgtggatttaacgccaagtattctggtgatttgattttgtcacgattgaccgcttccgcttcgtacggtttaccaatccattctaacgcagtatgcggaacaaaagagcaagcgcctgggagataataaagtttcataggaatccttaataatacatgctgatataagctcaaggatcatagcatgccattgagttcattttgcaaaatttttcatgaaaataaccgcttgtcttattctctttaataaaattgttataaatatgttaaatttttgtttaatttatgcataatgaaagttgtttaattagccactaccaaggagtatatatgcataaaaccatgaaaaaatatttcttacttagcagtttgactgtggcattagccttgcctctatccacagagctacttgcaaacacacagcctacaatgacgcaaattgctgcccagcgttatgacagtagcaaagatattttccatcctgtttatgcaaaacacggtatggttgcctctgagcaagaacttgccacacaaattggcgtagatattttgaaacaaggaggaaatgccgttgatgctgctgttgcagtcggttttgcattagctgttgtattaccaaacgcaggaaatattggcggaggtggttttatggtgctacatgatgcaaaaagtggcgaaaacttcactgtcgattttcgtgaaatggcaccgattaaagctacaagagatatgtacctagatgacaaaggtaatgttgtagatggtaaatcactttacacccattttgctgtgggtgttccaggaaccgttgcaggcatggaatacgcattgaaaaaatggggaagtctgccactagaaaaaattctagagccatcaattaagcttgccgaagaaggatttgtggtaagtggcaccttagcaagtacattaaaagaagaaacggaaacattaggtaaatgggaaagcagtaaaaaaatctttttcaaagatggcagaccattaatagctggtgagcgtttagttcaaacagatttggcaaactcattacgtcaaatcgcaaaagagggatctaaagccttctatgaaggcgacattgcgaaaaagattgttgctgagatggagaaacataatggattgatcaccttagatgacatgaaaggttatcaagccgtcgaacgtaaaccgattactggtgaatatcgaggatacaaaattgtgacaatgccactgccaagctcaggtgggattcacttagtacaaatcctcaatatgttagaaaactacccattaaatgaatttggttctaatagcgccaaaacgattcaccatctcgctgaaacaatgaaattggcttatgccgatcgctctgaatatttaggtgatccagattttgtaaaagttcctgcgaaagggttaacctctaaagaatatgcaaaatcactcatccaaggtattgatgaagaaaaagcacgcccagcatctgatatcaaaccaggacaaccacaatcttacgagagtgatcaaaccacccattattccgtgatggataaagaaggtaatgctgtagcagtcacttatacgttaaatctcaatttcggtagtggtattgttgccgaaggaacaggaattcttctgaataatgaaatggatgacttctcagctaaacctggtgttgcaaatgcctttggtttaattggcggagacgttaatgctgttgaagggaaaaaacgcccactttcttctatgacaccaaccttagttctgaaagaggataaaccatggttagtgactggtagccttggcggtgctcgtatcattaccacggtgttacaaagtattttaaacaccgttgatcatgggatgaacccagctgaagcgattgtaactcctcgcgtacaccatcaatggttacctgatgagttacgcattgaggaaggaattagtcctgataccctcaaactcttggagcaaaaaggacataaaattaatgttaaagctcctatgggaagaattcagattattcaagcgagagaagatggattttatggctactctgatccgagaaatccagatggtagaaccattggtttctaacgtctatctataaaaaagggcatagtagacaaaatggttgctaattttgtaaaaactatgcctatatgacaaaggagcctctcccacaatttgtgtaaatatctgtttctgagataatacattcagacacaggtattttattatgaacgaaaaacaacttcacgccttggcagcggaatttgccaaaaacctaaaaacatcagcctagaaaaggtaaaaatgcacctaacggttacacatctaagaccgtcatttgtgatgaaggtgagatagaaattgagacgcctcgtgaccgtgacggcacctttgaaccgcaacttatcaagaaaaaccaaacccgcatcacaggaatggatgagcagattattgccttaattgccacattttttgattatccggctgatattcgtaaagcgatttataccacgaatgttgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccgttaagttgaaatgggtatttacacagaatttgggatagggtcaatctacgtcagtctcctattttattacagcctctacatctctaatgcagcgcattttcttatatcgctttgccaaaaattaacagctattctatctttcataaaatcttctaccactttccaccaattttctgaatatacctattcgtcgcaatcttcgcagataaccacccaagaaagatactcagtgccataataaaaatcgcctcactaacatcaaagccgtgtagttcaaattttaccgtaaacatatctgatacataacgaactacccctgtaaaatagctgatagtcattaaactaaatagcatcgctagtaggcttccgagcaagccataaatcattccaatatataagaatgggcgtgaaataaaatgatccgtcgctcccaatagttgcatcacatcaatagatgctttgctattagacacatcagaacgaatgctgttactgataacaaggaaaacggcaatcagcatcaacagcgtacaagtgaccgctacacgagcaatgagttgggtaatcgctgtaagtttttctaaccaaccattgtccaaacgtacttcctgtacccctttaatattctgcaaaccattgcgaagttccagcatattttcaggtgaggtaaaggtttttttcggctttaagagcaccacggctggtagtggattgtcatctagaatatctaacgcctcaccaaacccagaccaagtacgaaattcatcaaggctttgttggcgagaaatgtaattaagagagtccaccttatcggtatcaaactgacgaatccgttcaacaactgcattaatatcgtgttctgctaggtttttatgtagatagaccgtcaattctggctctgggtaaaattccgtcgctgcctggctcgtatttttccataataggtagctgacagtcggtatcgttaaggacactgcaataactaataccgttaaaaaggtgccaaatttacgtttgagtagatcttgccacactgaacgcagaataaaacgggtttgagcattaagtgaatttagcattgtcgatccttactttaaatgtccttcttccaactctagacacggtttagggcgttgggcgataatgtttgtatcgtgggtggcaatcaatactgttgtgcctgctttgttaaattcttcaaataaacgaaaaatttcaaaagagagtttgtcgtctaaattgcctgttggttcatcagcaagtaataacagcggacgatgaacaatcgcacgagcaatatctacacgttgttgctccccacctgacagatgaagcggtcggaagttcgctttattttccaagccaacacgagcaagagcaaggcgagcttcacgttctgcaacggtttgattaacgcccataatgatcaaaggtaatgctacattatctaaaatcgagcggtcgctcagtaggctataattttggtgaaccataccaatttgacgacgtaaaaacggcaattctcgttctgcaaggagcgtaatgtcgtgtccgttgaacatcacttgtccgccattggctcgttcaatgcccataatcagcttcagcaaggtggtttttcctgcccctgaatgccccgtgatatatttcatttccccttctgcaaggtggaagttaatcccttgcagagctggtcgtccaccgcctttataggctttgctgacattagtaaatcggatcattacttctcgtcctcgtgagtaaataaggcttcaataaagtcttcggcatcaaatgggcgtaaatcatcaattttttcacccaccccaataaagcgaattggaatattgaattggtcggcaatcgcaaaaattaccccacctttcgcagtaccgtccagttttgttaaggtaatccccgttaaaccaaccgcttcattaaacagtttcgcttggctgatcgcattctgtcctgtaccagcatcaagggtaagcataatttcgtgcggtgcggtttcatcatattttttcattactcgcactatttttttcaactcgtccattaagttatttttgttttgcaaacgtcctgcggtgtctgcgattaacacatcaatcccttttgctgctgccgattgcattgcatcaaaaatcactgacgcagagtcagccccagtactttgtgcaacaacaggaatgttattgcgttcgccccatacttgaagctgttcaacggctgccgcacggaacgtatcgccggccgctaacatcactgattttccttccgcttggaattttcgtgctaatttaccgatagtagttgttttaccaaccccatttacccccaccatcaagatcacataaggttttttatcttccaataccaatgactgagcaacaggtttcagcacatcggcaagttcaacttttaactgctgatagagcaactcagcgtcacgtaattgctgttttgtggcgtgttcggttaaatttttaatgattttcgtggtagtcggcatacctaaatccgccaccaataactgttcttctagctcttcaaacaactcatcatcaattttcttaccactaaagaaattacggaagccagagccgatactctgcttcgttttgattaatcctttgattaaacggctgaaaaaaccgccttcgctggttggtttttcttgatattcatctgcctgaacacgttcttcgactggactttcatcttcgacaagcggtggattttgctcagaaatttgcaactcttccgtttgttcatctgagttttctgtagtttctgcggtgggttcaacaaccgcttgctcgacagtttcaactgtttcttccgccgtctgttcaacgataacatcttcgacaacttcagttgggacttcagtcacgttttcggttgttatattttcttcgataacttcttcatcttttgcaaaatattgcttagaactgaccgctcgttcggtgatttcctctggctgaacttctgctttctcttctactttttcttcggtcgttcccgtttgttcaacatcttcttttttcccgaaacctaaccaagaccaaaagccttttttcttcttttcatctgacattttttgctctctcttaaaattaaaaaatccattttcgataaaaatggaataaacttgtattagtctatcatttttaaccctaatttttacgatttcgtatgaaaaaaactcgaatttctacacaaaacagaccaacaggcgaagtccgtgtgattgctggtttatggcgaggacgaaaactgcccgtattaaacgccgaaggattacgcccaactactgaccgagtaaaagaaacgctctttaactggctgatgatggatattgctggctctcgttgtttggactgctttgctggcagtggctcacttgggattgaagcactatcacgccaagcacaagcggtcgtattcttagaaaaatttgcagatgcggcaaatcaactcaaaaagaatttagtcagcctaaaagctgaaaatggcaaggtcattcaaacggacacattacaatttcttgcacagaaaaatagcgaggcaccttttgatctggtttttgtcgatccgccatttcatcaaggctttgtaccacaagtcttaacggcacttgaacaaaacggctggctggctgaaaacgccttgatttatgtcgaaactgaaaaaaatcactcgccgttggtcttgcctgaacattggcaggtagttaaagaaaaaacagcaggacaggtggtgagtaggttggtgaggacttgataacacaaagctgtgggattgtctcaaatatgcaaaatctcaccgcttgttgttttgttatttccccaaacgttgttccatacctgataaaaaagtttccatagactgttttaaatctatatccattcgttttgaaagcacggcaagccaccaaatacattcagccaatttatgtttaagttctggcgtcacatctttatttgaaacccagcgttcttgttgcgacatcgttaaacgaccgactaatcctgcatcactcaaaaaggctaaggcatcttcaatcaccgaccattcggtttgatgattttgtcgttctagctgatgatatttttcacgaatggcttgtgaacgttcgataatgtgttggaaatccataatgttccttatttattttacagtttttgttccatcaaggtttttaacggttcaagccccaagcgttcatagaaactgaatgccccttgattgtcattccaaacgtgaagtgtcacactgtcgcaagcgtttgctttggcaaagtccaccatatactgatacaacttctcgccgattttcttgcctcgttgtgacgcatcaacacagagatcgtcaatgtacaacacattgcgatcaaataaggctggaatgccttgcataatttgataaatgcagaaagcatagccttgcacagtgtcgttttcatcttcatacacaaagatcggtttttgttcgtctgccattaaggctaaaatttcttcatcgctgtatttgcgcttacccgcttggaaaatatcagggcgagcttcaacgtgaacagcgtgaacttggtataacaactcggcaatacgagcgacatcatcggcttttgcaggtctaatcattgtttttcctaaatcgtgtttaactgtgtagcaagttgatttaataccatttcggtatcatcaagcaactgctcaaatttctccataccaaactgctggcttacttgcaattctgcttcggttagccgagcaataatcgggtcgataaaaattttaccgcttgcacttaaagcaatcaacttactgcgtttgtcgttctcatcaggcagaaaagccaaaaaacctttttggtctagttgtttacaaacagaggttaccgtttgtttcggcaaactccatttatcgccaatagcagtaggtgaagtcgcaccatagcgaccaatggaatacaaaaaatgcaattcatttaaggtgagctgatgttgtttcgctacactagcataaatgctcgacagctgtgctgctagctccaccaatttatcaaaggggggcatttttacgctccaaaaatttgacacgagtgatgtcataaagccagttaaacaccaaggtatacagcataatcagcaagctcaaaccaatatccgccaaaaaggcgtgccacaggcttaaattcaataaatacgccaccaccggaatggtaaacagcaataaggtacactcaaagcagacggtatgtaaaatgcgtaattttagactacgttcttcccgcttgccggtaaaaattttatcaaacacatagttaaagaagaaattaagtaccattgccatcacagacatggcaacccccgttccagccgcagcttcaaggctgaaatccccagccaataacactgcaaccgcaccgattgccattgctccaatttcaaataataccgagtgaaaaatacgttcgtaaaaagtcataaaataatcctatatcgtactaaataaatttattttagtacgatataggagtaaatacaactctatttgcaaatttctaagtagatctcaccgctttctaatctaacgctttaatcccttgaataatttggcaatggtcaatgtcttccgcctgacagtcaattaatggctcaagcaatactttaatttgattgagctgatcgatttgatgctcaatttggattaaatgctgtttcgttaatttatccaccagttcgcaacgattatgtggattagtttgcaacatgattagttgtttaatttcctctaagcgaaagccgatcatccgacaacttttaataaaatggagctgattgagctgtttttcactaaacaagcgatagccgtttggttgccttgttgcagtatcaattagccccagtttttcatagtaacgaatggtttccaaattcacgccactttctcggcttaattcacggattttaaaaaattttgccatggatgcttgaccctgtaattgctacggagtttatagtttacgccaagttaaacaaaaacacacggagagactatggcttgtacgacttcttgctgtacttcacacagcacaaacctttccccgaaatatcgcaaagcattatggattgctcttggactaaatattactctgtttttcattgaaatcgtgatgggcgtaaaatcgggttctgtttctttactttcggatagcttagatttttttggcgacagcgccaattatgtgattagcttgatcgtgttgcccatggcgttaagttatcgtgctaaagcctctttattaaaaggagcaaccatgggtggatttgggctatttattttaatcacaaccctctatcgttgggcttatggcgaactgccaaaccatagtgaaatgagcgtagtcggtgtgcttgccttattcgccaacctaacagccttgtgggtgctttatcattttcgtgatggcgatagcaatatgaagagtgtttggatctgctcccgcaatgatgcgatagggaatattgcggtcattttggcggggattgcggtctattttacccagtcgaaatatcccgatttgctcgttgctttcgttttggctttattagctctgcaaggtgcgagagagattattgttaaggcattaatggaattgaaaggataagaaaatagcggtgagattcaatgaaaaatttgcaaatttctaagtggatctcaccgcttgttatcattattccctatatctagggtacttctgtttatcttcttcagtaatcgctctcactactcggcatgggtttccaacggcaataactccagccggaatatctttagtaaccacgctaccagcgccaataattgtatcattaccgatagttacacctgggagaacgactacattggcaccgatccagacattatccccaaccgtaatcggtaaggcaatttccaagccttgattacgttgctcactatcaagtgcatgacccgccgtagaaaaaacacagttaggcgcaataaacacataattaccaaaggtgatcggtgcggcatctagtaaagtacagttataattgctgtaaaaatagcgaccaagccgtacattaacaccgtaatcgcaataaaatggtggcgtaattaccgtatcttcttttatctcgccaaataatgcttgcaaaattgcctgacgttttgcggtatcggatggtttgcaatgattaaattcaaaacagagatctgcagccttgaatctagcggtaatcaaagtgtcgtcataattcgcatcatataaatagcctgcttgtgctttttcccattctgtcatgttcgttcctttgtctaacctatatatctcaattataggctagttgtattgaatacaaagcagatttagataaaagctaattttattttttataaggcatctacataatcaactaacagtttaccatcaccatacaacaactggcttggcacaatatgtaaccgatcgtctttttccacaatcaactgcggcacgccttgcacaccacaatggttagcgagttgttgcccgaattgaagacgttgttctaatgctgtttggatagattcttcgctaagcaatggcacagcttggctaagattgagcttgtgcaacacctgttcaatcacagcaaaatccgcattatccaagccgtccacataacgtgccgtctgcaacgccgccaacacggcaagctctttttctggcgcaatttgttgcaccgccgttaaagccaacaaactgtttgttgaatcaaactcgccttacccttgcaacacgttttccaaatatgcttgactaaacggctggccggtcaatttttcaatccgttgatcgttactccacgcatagtgggcgaaatctgcatccattttgcgaccgctttggtaaaacaagcctgttggcgttaaggtaagcggatagatttcattgagtttttgcaatgtcgctgacgcaccataacaccaaccgcaaagcgtggaaatgtacgcaaggggaacgggaagtgttgctcgacttaaacagccgtttcactaccaacgacacccaagcactgctcaacgccgtgctagacgggagcgacattgcgatgttgccaaaatatatgctggaaaccgaactacaacagggcaaactgcaagccgtcctacccgattggcaactgccgacattcagaatttatgcgatgtatccatcaagggacaaactcccccttgccgtaagaaaattgattgattttttggtggagagttttgaagggaaagcgtggtaggggatgaaaataagcggtggaatttggggagaaatttgtaaatcacgatattatgctgatgcaatacaaaattatccgtagataccataagacacaacaaattttatttcataaatgtgtctaaattaaatgctgtctgtttttgcaaaacagcctgtgcaatagtgactaatttacgcattaaagccgtgataatcaccattttaggtttgccgcattcaagcaatcgcagcacaaacgagcgatatacgctgtttttgtagctgccaaaggcaaagttcattgcagggcaaaagagtgccttacgaatgtcggattgcccgatttttgaaataccaataacggtatttaaacttttccccgaacttttaatcatcggggttaaacctgcaaaagtggcggctgctttcgcgtttttaaaacgatttccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacattgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttccatcacgcagtgaaaagtttcaccaaatgtattgagccattgcataagtgattgaaatccttctggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggcaaaggggaaaggttatttttttcgacgcagatcgcaaaaatttgagaaaatccctccgcgtttttatctctcaatcccttaaaccaagatgaattttggtggtggttggggtaagatagacggtatccgtattcgctatttaagcaagttggcaatctgcaatactacaaacttaaccttaacttaattacccttttacccaatgtacaaatacaccaaattcacccagcaccttaaacatttaattgaaacaggcgagttgaaaccgcacgagaaattgccgtctttgcgagatcagacagcattcggggctgagtttgatgatggtattaaacgcctatcaagagttagaggctcagggggtgatttattcggtgcaaaagagcggttattttgttgcacctttttacccgtcttctcgtccgcacgccaacagtgaaattaggttgaacaaacaagtcgagattaattcgttggtgtttcgttatctgaaatccattacggatattgagcctttggggtcgccttttccgagccacgattatctcaatccgcccaaattgctacaaattctaagccagcttagccgtgatagaacgcagattgagccacagcctgtgttgtcgggcaatgtggacttgcgtaaattaatcgcacaacgttaccgcttgcaaggtgttcctacgcaagccgatgatattgtgattacgtccggctgtttagacgctttgaacctttcgctacaagccttaacgcaacagggcgattatattttattacagcagacggtattttatggggcgtggcagattgcggaaaagttaggcttaaatgtcgtcaccttgcccgaccacccaagcggttttgtggcgtttgagcaagccttacagcgttatcccatcaaggtttgttggtttatgctgaactgccataatccactggggtttaccgtcagccccgaaatcaaacagcagattggggaattgttagctcaatatcaagtgcatttaattgaagacgatgtgtatcaagagctttattatcggggtgaaaagcccttgccgatgaaggcgtttgatgcacaaaactgggtgttgcattgttcttctttttctaaaattttaggggcaaacttccgtatcggctgggttcacgcagggcaatttgccgataaaatccaacatttgcaactgatgagtaccatttctgctaacgctttaattcaacaagccttggtagaatttatctctaatcaccactacgagaaacatctgcgacaccttcgccgtcatttagaaaaaaacaaaaagcagtgtttggattacctacgtcagcacttgcctgcaagttgtcctatcgaacaccacagcagcggctatttcctttggatacacctgccagaacatttggatagtatgcggatttatcaacagtttctcgaagaaaaaatcagcgttagcccaagtgagctttttaccttgcctacttcgcagcataaagggattagggttaattgttcttatgcttggaaccaagagatcgaacagacgttaggggttttggtgagggtgttagcaaaatagcggttacttcatagaaactttttgcacctgtttcattatgcccgtgaatatttgatcccgtacattttcatctatctgtttgggtagtgttgttgctacgctatcaatggtttcttgcactgtatcgcaaatttgctctatcacttgtttcatatcacttgagctaaatccgacaaacttagctgtggcatagaaatgttcagcgtaaattttattccaatgccattttttccctttttgtgtactacgcaagctcattgccatttgtaattcactgtgatgccaaccttttccgcctaacattggataagcagaaagtacgtcatacactggggataagtgataacgcccttgtttttcaatggcgagagaaaagtttttagcgtgtccatcaatggcagccagtagccaaaacagaaattgagtttgcataaattgacggcgatcgttggaattactggagtagagcaacttattcatcatatccccaataccaattccaccatcgctttcatatttttgcgttggcgataagccgaatgcctgacagaaatcttcgtaaggtaaacgtaaaaaataactgccatcttgactaagacggcgatcaaaacgttcaacagctaatgcccgtatatcgttcatttccaataattcaacgtttgcggaagggatattgaaagcagaaaataatctcaaacagacgagttcgttatctacactttttgacagatcaagcaggtgtttaggggtacgaatttctcccataggcaatttgaaaatatgcgttgtcggggtcaatccgtgtggtaatttccatttgccgttatgccaaagcagagctgtcttttcttgtgcaccagcaatagaaattctgaagtcctgattattatcaatcataccaagtggggcattgtattgataactttgtagaattttcgtcatttcactttcgtctaattctgtggcttgaattattcgatgattcggaatttgttcatcttcccctaaaagagtaatagcacccgcagcatcgcgaccaattttagcaagtaagtcaaaaggttgttgtgtttcagcattaaatcttgtcgcaattcttgctcgaatttgaggattatcgggcagtaaattatcaaagaaattaatcacttctttgccttgatatgttgctctttgcaagggcatagaaagggaaatcgggcgagctaatggggaatttagccaactttcagcataggtaaaatggtgggaacccgataaagtgcggtcaaaatacccaaccatttcgccattcattaatactcgtaatcgcattaccattcatcattcccctctgttttttcaggacgaggttggatatgtagttcatagcctaaacctgaaagtaacttgaataatgtttcaatagtggctttatcggtttttttctcaaaggtggaaatcgtggcttgtcttaaagctacttgatttgctatttgcatttgagaaagctttttttgcttacgaatatcgcgtaggctatttccaagcatatctggtgtcgtgattaacatatttcttccaaatttattttatactaagtgaagtataatttatgaaatatacgctgtaaagtataactatgatttttatactttatagcgtatatagataatctgaaatgatgtatagaagtgttgggtatttattccaataactttttaatgattcatcaacgaaaaccgcaaaaactcgacaaaatgatccgcccagtgcatttcgtggtggatttcatttgccataatttttagacgaatattatcgagaggatgtcccgtgcggattagtgcttggtaataatgcagcgtacagtcaatataagcctgattcatatttgaaataaaatgtgaatccacttcatcgccttcattcgttcccacttgaataaacactttgcttgagcggttgagtgggtgtgtatgaataaattccataaaggcaggttcactaaaccacgaggcaagagaaaatacgcctaaatgcccgaatacttcaggatattccgctcccatataagcagtgataataccgcccattgagctacctgcaagtagggtatgatcacgatcacgtttagttcggtaatgttgatcgatgaaaggcttaaccgtttcaaccacccaacgcccatacgccattccatatcctccagcattttgggtttcaggggtagagcctgtgtctgttcgccacggaccatattcatcaagacgatcagggcctgcattgtcaataccaacaatgatcatctttggaaattctttgtgatttttaatcgtcggaatcactttccaagaatgtcccgaataagactctttgctataaaaaatattttgtccgtcgtgcatatataacacgggataatgacctgcttcttcacgataccctttgggtaaaagcacacggattcggcgttgttggttgagataaggtacatttagataatgctctcgcatttcaaggaaataatattgaagaggatctcgcattgtaaaacttcttggataaaacagataatcgggtcaagtatatcacaaatcatctttcccctaaaaatttccctatcatttgtaaaaatccgttaaaatctcaccgcctatcattatttagagaaaaccaatgttaaaccaagtttcaaacagtttgctgttacctagcggacttcaattatccgatctgacgaaagtgttggatcatttttctagccgtcaaatcgactatgccgatctctattttcaatttagccaagatgagagttggtcgttagaagatagcattatcaaagaaggcggtttttatatcgaccgtggtgtcggtgtgcgtgcggtgtcaggggaaaaaacaggctttgcttatgccgatcaaatttcgcttagccagcttgagcaatgtgcaatggctgctcgtagtatcacgcaagaaagcggtcggttgttggtaaaacctttcaaagaaacgaccgctatcaaacgctatgcctcgatcaatccccttgataccttaagtcgtgaacagaaagttgaactattacatttagtcgataaagtggcgagagccgaagatcctcgtgtaattcaagtgaacgcaaatctgtctgccgtatatgaagaaatgttagtgtctgcaacggacggcactttagccgcggatattcgcccgttagtacgtttatctatttcggtattagtagaacagaacggtaaacgtgagcgaggcagtgcaggggctggtggacgctttggcttggaatggttcttagcaacacactatacaggcgacagtcgtgccgtctaccttgctaaagaagcagtgcgacaagcggttgtgaatttaggtgcggtcgctgcacctgctggctcaatgccgattgtgctgggtgctggctggccagggattttactgcacgaagcggttggacacggtttagaaggcgattttaatcgcaaagaatcatcaatgttcacaggcagaatcggcgaacttgtaacatcaccactttgtaccattgtcgatgacggtactgtaccgaatatgcgaggttcgattaccgttgatgatgaaggtgtgccttcacaacgtaatgtattgattgaaaacgggattttaaaaggctatatgcaagataagctcaatgctcgtttaatgggcgttgccccaacaggtaacggtcgccgtgagtcttatgcccacttaccaatgccccgtatgaccaacacctatatgacagaaggcaatcacgagttcgacgaaatgattgaatccgtggactttggtttatacgctccccatttcagcggcggacaagtggacattacctcaggcaaattcgtattctcaacgtccgaagcctatttaatcgaaaaaggcaaaatcaccaaaccagtcacaggagccaccttaatcggcagcggtatcgaagcaatgcaacaggtgtcaatggttggcaaaaaaatggaactggatttaggtataggcacttgtggtaaagaagggcaatctgtacctgttggcgttgggcaacctacgatgaagttggataagattactgtggggggaaggggttagatgtgctttatttttgcttactagttgaaattatcacagattgaatttatggtatttttttagaatgattctaaaaatagatgacaaggttatagtgcaaagtaataacgtacttgaaaatccttgtaacactcaaaaaataataagattcacaagaaatttgtgaaaagatcgtggcaacaccagcagaaaatgctagaattgcacgctttataattgaatattcacttttgtaataaattttaggttgtctatggctaaagaaattcaaaacataaccctggataaagtagaaaagggtgtcaaaagtaaaggtataaataatgtattatgggtattttcaatttcattattaacaatagcagctattggaaatacctattttgcagaatacttttcattaattgttcgtatattgctgttagttgtgctatgtgttgctgcattgggtgttgctgcaatgactaaccaaggtcagcaatcaattgattttatcaaagattcgcgccaagaattacgtaaaattatttggccaaatcgccaagaaacgacgcaaacaactttaatggttgtcgcaatgtgcgttgtagtggcattagcattatggggtatcgactctattattgtgttaattattgatttcctaacaaatttgagattctaatatgagcgagattgaaatagtcgaacaagaaaaagatacaagcaaaatgcgttggtttgtattacaagcgttttcgggctttgaagcccgtgttgcaatgactcttcgtgagtatatcaaattgcataatatgcaagaccaatttggtgaagtgctcgttcccacagaagaggtggttgagaatgttggtggacgccgtcgtaaaacagaacgcaaatttttcccaggttatgtgttagttcaaatggaaatgaatgatgatacgtggcatctggtaaaaagcgtgccgcgtgtaatgggctttatcggaggtactgcggataagcctgcaccaatttctcagcgtgaagcagagcgtatccttaaccgtgttcaagaaacggcggataaaccacgtcacagaacagaattccacccaggtgaagaagttcgtgttaaagaaggtcctttttcagattttacaggcactgtggaagaggtggattatgaaaaaggtcgtgtcaaagtgtccgtttccatttttggccgagcaacgcctgttgaacttgaatttaatcaggtagagaagcaaaatacttaataaatattattgcaataagtaaaggaagcctatcgctatttttagccaaataggcggcatagtagacaggcatggcattttgtctactatgccaaagttagatgttaaataaatgtcttatttttctaattcttctctgtatatccttttaatttacaaattaattcaagtataagctcaaatttattccaaccttcccgatctaaaaaatgccccccagttggcaaacggatatagtctgcttttaaatgtttggctaaatcatcactatattgatgtggcacaacagtatcatcaagcgaagcgacaacataagatttaaacggctggcagtcaggtgaaactgcataaacattagagaacgtggttaattcaggcaaattgggtagaggttgatggaatcccgatacaaaaactgccccctttcgtgcagagggctatttcgcagtttgcttggcggtacgcaaaaaagtgtgagtacggaaatcgctcgccaagttgcccgcccgccgttttcttgccccgaacatctgtttgtatcggtatacaacggttgtggagagtgcaaaattgcctgttttgtaggagccttgggattggaaatgtacaagcggtaagagcagttgctaaatttgcaataaatcttaccgcttgaacttatctagtgtaatgctttcagtgtagtaactaactgttgataacgctgatatttttgttgataggcttcaaaatgttcaggatttggttgcacttgacgcattgcttgttgcaatagttctgggcgattttcgtcagccgcttccattgccatcatcgctgcccctaagcaacctgtttcttcaatattcggtacttctaatgtcattcctgttaaatccgccagcatttgtaaccaaattggcgacttcgttggtccgcctgtaacacggagtatctgagtattcgggaagcgttgtagcattcggttgagatgatgcattaagctgaacagtacgccttcgtaaatggcttggagtagatgagcttgtgtatgatatgcttgtattccataaaaacctgcttgcatacctaaacctgcgttagagccataaaggaatgggacaaacagtacagagctagcggcaggcgcgagttcggcaatcgtttgattaatgtgagcgtaatctaaattccactgtttgataaaccattctaaattacccgctgaagtcgggctggcttcgtgaacgataaatttgcccgcttgtgcataacgtccgtaaacaaacggtaaatcttggtttggatcgatatggtctgtgataccactgacaaccgaccaagtaccgagtacggcattaagtttggtttcatcatctaaccctgcacataatgcggtagagacgacatcgaataagccaccgaccacaggtgttcccaccgctaaaccacaaagagcggaagccttttcggtcacataacctgccacttggtttggggcgatcacaagcggcaatttatcaatgatttcttgcaaaccaagtatttcagcaagttggagatcgtattttccttctgccatattgtagagattggactcagaaatattggtttcttcacaatgtaattcaccagtaaggcaaaagcgtaagtagtcgtgtgacattaatacagaaccgatttgtgcataacgttctggttcgtgttcttttatccagcgtaaaatggaaacagggtgccctgtccataaggtttggcgggtgattgggtagagtttttctggtatgccttctttttgccactgtttaacgatgtcgatagaacgttggtcggaagataagatcgctctacctagtggttgtttatttttatccagtaaaaacgcaccttttccttgagctgaaatgcctactcctttgattgcggttggctctacatcacttttttcaagtgtttggtgaataacattggcacagacttgccaaagttgagccatatccctttctgcataacctgctttttcgctgatgaccgctacattttcacgagcaagtccgcagatttgtccgtgacgatcaaacagtgctgctttaataaaagtgccaccacaatcaatgcctaagtagtagttcatttgagttcctttttatttctgtattagcaaatcccccttttgggaaaaagggggatagagaaggtgtattatttcgctaacccatcaattttttcaactaattcactgccgtttttctcaataaaggctttgcgaacatctgcttcaatgatggctttaaacggtttgttatctacttcttcaatcacttgaatacctgctttttgtaatttagcgatgatctctttttcattctctaaattaagttggcgttgatagttgcctgcttctttagctgcatcaagaattgcttgttgtaattctggtgagaaactgtcgaatttcgctttgttcattacaacaattaatggagtataaccgtgattggttaaacttaaatgtttttgtacttcgtaaagtttagctgaccagaaaataccgattgggtgttcttgtgcatctactgctcgtgtttcaagcgcagtataaagttcagaaagtggcattggcacaggatttgcaccaagtaggctaaatgcctgaatatacattgggttttggttagtacggacttttaaccctttgatgtcttcaggtgatttaactgggtgttttgagttagtaaatgagcggaacccgacttcccagaaagctaagccttttaatccttgtgcttctaaatcttttaataaaccttgaccgatttcgccgtctaatacagcataagcgtgttcacggtttttaaagataaaaggaatatcgattacatttaattttggctctagacctgagaaatttggtgagccagacatttcaatgtcgatagttccgccacgcactgcaccgatcattgtttgtgcatttcctaaggtgctatcagggaataagctcaatttgatttcacccttacttttttctttcagtaagtcattaaatttttttgctgcggtatgttgggtatcgctacgaggtgcttcgtaaccaaaacgtaatgtggtttcagcattcgccgttccactaaacaagacagcagaagcgattaaggcagtgagtgttttaagattaaacagtttcatagtgttctccttgtaaaattaaggttgcatccacgaaagtggcgttaaaattaatgatgggaagaagacaaaggtaaatagcaatgccaccatcatcaacatataaggcaatactcctttagcagcttggtcaaatggcaatttagatatgcctgtaatcacgttaagtacgttacccacaggtggggtaattaagccgatggaggtatttaagataaacagtacgccgaaataaacaggatcaattccagcttcttcaatgagtggcatcaataccggtgtgagaattaaaatcgtaggtgttaagtccattaccattccgatgatgaatacggcaatcataatcacgataagtaatagagttggagaaccgatgagcggttcaagtaattctgtcatcatttgtggtaattctgctacggtaattaaccagcccgtgacatttgctgctgcaacaaggaacattacaacagcggttgtttttcctgcattgagtaggactttatacagatcttttagcttgagttcacgataaacaaagagcgatacgaccaacgcatagaacgtcgcaactgcccccgcttcggttggtgtgaacattccagaacggaaaccaccgatgataatcacgggcagcatcaacgcccagatactatttttaaaggaaatacaaagctcttgtttcgtcgcttttgagaatgtcattaaattaagacgttttgcctgccaccaccaaagtgccgctaaacaaactcccatcataataccagggaaaatgcctgctaagaataatttggtaatagatacaccgctggcaacaccgaagacaataaacggaatagaaggtggaatgatcggagctataattcctgcggtgccgattaagcctgcggatttagcgacaggatagcctgtggttttcatcatcggtaacaacatggcagcgacagcggctatatcggctacggcagaaccggaaaggctcgccataatcattgccgctaaaattgccacaaaacctaatccaccacgtttatgtccgactaatttcatcggcagatcaataattcgtttggatagtcccccctcattcattatttcacctgcaagaatgaagaacggaatagccattaatgaaaagctatctgcaccactgacaatttgttgagcaagaatttgtgcatcaaacagatcaagatgtaacattaatgcgatgccacaaactaagagagcaaaggcaacaggtatgcctaaaataattgcacctaatagtacagaaaggaaaattaccaccgtcatttggtttctcctctaataagtattgctgctgttgatatcactcttgtggcaattaatattgcaataaacactcctgaaataaccgctgcaagatacgttactcccgttggtatttcagatataggcgataagttatgaagatttaattggaattgaacccagccaccttgcacaacgagatagcagcaaaataacataatgctatctgtaaatagacgaaggatatggcgtgtggtaggggaaagtttgtcggtaagcatagtgacactaacatgttgattatcgctaaaagcaagaattgctcctaagaatgtcagccacacaaacaaataacgggaaacttcttcggttatgttaatactgctattaaatccataacgcagaacaacgtttaaaaagaccaaacaagccatcgtagataagatgatcaccacaagaaactcaagggctttgctcgtataaagtgctagagatttcatattacacctcaatttcgctcattgcgattttgacgacaattttgcggatcatttccgtgccgtcgtaaatggcagtacggtgggtatcttcaggaaaaaagactgcgaaattcccttcaacacagtgaaattcattttcttgctcaacggctgagtagtattgaatatctcgctctggatcataggctgttgcaacagggttttgccctaaatcaatcgcacttgccattatttcctttccccgatgtaaatattgtacgtctaagtaatttcggtgaacttctggctggtaagcagatttaggtttagtttctaaatcaagaacttgtacataaatacgatcttctttcagtgaataacgccctacttcaaggcgatcaaagtcggtattttgtaagtaatctagagcaaattgaattgctttcggatattggcttttgtttacgttggaaatgtgaccgaagaacatttcatcctccttttagtaaaaaagatggaaaattggatcgctatatgtttatagcgacttcaatttcgcccaaacggtatcatctacaggaataccattcgctttgttctctgccagaatagtggtaaattcgtgtcctggtaagcgaattgccacatttggatcagaacgttccgctgtgcggacataatccataatccgttcaagtttttcttctttggttttgccatcaattaagcgatcaacttcgattgcaataaagatttgtgaaacacaatattcatcatctttatcttctgtcaccgcagcagtcgatagaccattagaaagtaaggtggcaatcatatctaacacaatagataaaccagaacctttccagaaacctgcaggtaataagcgacggtttttttctacagtacctggatcacgagtgagattgccgtcatcatcaaatcctgcatcaacaaaggttttgcgccccgctaaacgatgaacttccaacatgccgtaagagtacattgagcaagacatatcaaccattgtgattgggttacttggtacagcaataattaatggatttgttccgatacggcactcttttgccccccaaggtggcattaccgcaagggcgtttgtccaacaaatgccgatataacctttctcagcagcttgccagccataaccgccgccacgcatccagtgatttgcattttttaatgccactacaccgataccaaattggtcagcaatttccattgctctatccatcatttttttagcagttaagttaccgatggcttgatgtgcgtcccattgttcaattgcccctaacgaaagcactttggttggcactgcatcaggaataacatcgcccttttctaactgttgaataaaacgaggaaaacggtttacaccgtgagaataaacacccgcttgggtagtgtcagcaaacattgtggcacactcttctgcaatctcttcacgaacattgcgggcaagtagcacacgtttaaattcggctttaagcttttgatatgatactttcattagtaacccctttgtttcatatatcaaaatgatatttcataaattaaacctaaacagattaaaagtcaatcaaaccataaaaataaaaaccatttaaaatcaatatgttatttgtaaatttttagttttgtgagcaagatctcatttttatgggattgcattccaaaatatgaaacagaaaaatatgctatgataggtggcataaaatgaataagaggagaacaaaatggcagaggaaaaaagtggtggaaatcaaagccttattcgtggtttacgtttaatggatattttaagtaactttccaaatggttgcccactagcgaaattggctgaaatttcagaacttaacaaaagtaccgtacaccgtttactgcaagggttacaaaacgaggggtatgtgaaagcagcaagttctgttggtagctatcgtttaacaacaaaatgtctaagtttagggcagaaaacccttgcttcaatgaatattattcatttagcttccccgcatttagaacgattaaaccttgccttaggtgaaaccgtcaatttttcaaagcgagaagacgatcactcgattatgatttacaagctcgagccaacaatgggtatgatgaaaacgcgcgcctatattggacaacatttgccactttattgttctgcaatgggtaaactttatcttgcttatgaagaaaataaagaatatttagatcgttattggcaggcacatagcggtcagattgagcagagaacttgcaaaaccattacggacattcaagctatgcgtcaagaactcaacgatattcttaaatctggttttgcaatggatagagaagagaatgaacttggcgtgtgctgcctcgctgtacctgtatttaatcaccttggcagagtggaatatgccatttcagtttcaacttctattcatcgtttgaatgaatatacgatgggggattttctacgcgaggtacaacaaactgcacaagctatttcgcaggagttagggtggaaggaaatttaatcttaccaatgacttactatgtctaatctaaagtaatttagaatataaagtatagattggtggctaaggaggtgatttactataagcagtaaactattatttatggttatatgctaatatagatatctggcatagtagacgaaatagttgctaatgtttattttctttaaatattagcaactctttttatttgaaaaatcatttataaacaaggtgttataggtttcgtcaaccccttgtgattatttgatttccacttaagttttctaaataatccctctaagtgatttattgtcttttctatatttaattcagaatatttctcataggtaaaaataaaatctatataatgctttaaactggtataagtacttcttacattacgatatttataaggaatgttgataggtttgttttccagatgtgtaatcagtccaaatttttattggatctaatttattcttaagggaaaatgttttatgacacttatgacaaaaatatcgttgaatattatttgatgtcctatgttttttattttcaggctttggcaaaatgggcagttttttgttcatgtttcaaaaagagggcttaaagccttgtactatcgatattatgtagcagttgctagataaattttcctactatgtcgtttattagctacaatacgttacccttccaaaacacccaccacaaactccgcaatctgctccacattattaatatccaacagattttctctttccaacagataatccgttgcggtggcaagggtgaaaggatctaactcaggtaagggtttatccatctcttttcggtgtagctgaattttcggcaaggtttcgtgtttgaagccttcgactaaaatcagatcgacattttgtgtttccatctgttttaccagtacattaaaagacgcgagagtattcgtttccaccatcatcgcccaacgctgttcacacacaatcattgtcggatttgcccctgctaaacgtaggcggtggctgtcttttcctgctttatcgacatcgacattatgatgagagtgcttaattaaacctacttttatccctttttgatttaactggggaatgagcttttcaagtaaagtggttttgcctgtgccactatagcctgtcactgcaagcaacggaatgcccccctctgtcctacggacatctccctccgcaagcggagggagagaataaggaagaaaatcttctggtgtattaaaatttttaaacgcctgtttttgttcggaaaaatcaacggcaatactgcgttggctttggaaaaactgaaatagacggcgttcgccattattcaggtaatcttgtaatgcaggtacgacagaacgatggattaaagcaaaagtcgggtgtgggcgttcaccgtcgtgggcaaaggcaatttgagcattgttgatctgtaaggctgtacttagttttacggcaagattttcaggcaaaaatgggctgtcgcaagggacaaacagcaaatattcgctgtcgatttgttcaaagcccgataacataccgcttaacggaccttgaaagccttcaagacaatcggcataaagcggaatatcaggatagtgttgctgatactgcgcttgcaagcggttcacattcaaccagattttgcaaatttgtggggataatctttccaaaatatgagaaatcagaggtttaccttgtagaagttgcaatcctttttgtaccccattcaaacgacgagcaagcccccccgctaaaattaccccttgaatttgattaaattgcatttattttccccttgtttttgcaaaattaaccttaaaagtatatgatcctgcctagttttttccaaattttttaaggattttctgatgaaatgtaaacgtttagacgaagtgttagaactattaggtgaacattggcgtaaagaacccgatcttcacttacttggtttattacacaaacttgctgaagaagttggcaaaccgaatgatttagatgcgttgcgtgatgaagtgttaatttaccaactcaaaatgcgtggtaaagataaaacagaagttattccaggcttgaaaaaagattacgaagaagattttaaaaccgctttattaaaagcgcgtggaattttaaatgattaatgttgtcataggatcgacttttttaactcgaggaatttatgaagaaatttgctttaaaaaccgtattcattgccctttctgcattaggggctttttcaacaaccgcaatggcacaagatcctgttgccaataaagagtatctcgaagttcgccaagtgccttcggctcaaaaagaggtgttagaatttttctctttctattgcccacactgctatgattttgaattgaattacaaaattccaagtaaagtcaaagcaggtttacctgaaggggctgtgttaaaacagtaccacgttgattttttaggtcgtcaatcgacagaattaacacgagcgtgggcattagcaatggcattaggcgcggaagataaggtgaaaaccccattatttgaagcggcacaaaaagatgcgattaaatcaatggacgacattcgtgcgattttcttagcaaatggcattaccgcagaacaatttgacggcggcattaatagctttgcggtgaatggtttagtgacaaaacaaactcaagctgctgaagaatttaaagtgcgtggcgtgccagcattttttgtgaatgaacaatatcagctaaatccagaaggtttctccgattcaggctcaaccaacgaatttgttcaacgttatattgatgcgattttatttttagtgaaaaaatagagtgtatttgcaaaacaagcgttcaatctgaccgcttgtttttatctcacccaatcggctaaccataaccgaattttaatcccccaataggttgagaagccagtagtgtggctaatcattttgccatcttttacaataattaatgtcggagtcgcttgaatatcccaactttttgaaaatgtccctattggatcattgatagtcacaaaatgatattgatgcgctttcatatactgttttacttcatcatcacttcccgatttgagagcaatacttaaaacattggcgccatctagtacaagctgagaaatggatggggaggtatattcacaaaatttgcaccaactgccccaaaaatagagtaacagtgatttttggtggcttagttgtgcaataatttgaggatttttctccaaatcatataaaacttgttctgcaaattgatgagagggattgggtctacgaaaccaatctgctgcagtgttgatcaatacaaataaactcacaaataacaaaatatttttcatagaacagttgataatgccatgctttttcattttatttcttaccaccagtataagctgcagctcctctagctagcattcttaattgtgtaattacacgttgttttaatttttctcgttcttgactatttaagtctaaagcatgggaacctgctgtgaaaacgagagtaacaagtccttcagattgaatataagctagttcctgagttattgcgtgatctctttgttgaatatattctgcgagttctgctacaaaatgctggatttcacgtgacgtggcagttctaaattcttgcgaggttcctgatcgttctctcagcaaaagacgaaacatattagggcggtattcaataagttcaaaaaaggtttctacagagatagcaataacactcccccctttttctaatctttttctagcttggcgcattaattgacgtaagattaaccctgattcgtctaccattgctaaccctaattcatccatatctttaaagtgtcggtaaaaagacgttggtgcaatgcccgcttcacgggcaacttcacgtagacttaaatttgaaaaacttttgtctgcagttagctggttaaatgcagcatcaactaatgcacggcgagttttctctttttggatagctctgattccactactcattattgaatctctgacattattttttgaatctcttttgcaaggcgttcatatcgcaaccgtaatggggagccggggcgatagattaacccaattgttctatatggttcaggattattaaaatgaatatagtgtaaattatctgtttttccaattttagctgctagttcagggataaacgcaattcctacatctgcggcaaccatattacgtaatgtttctaaactatttgctttaaagtggctgttctcttttgctccgattgataagcaatagtccatcaactgtgttcgtagacaatgccctccatctagcatcaacatttcttgatcgcgtaattttgataagtctattgaggttgttgttgcccatttatgctgattggatactgcaagtagcattttttcattaaaaataggtatttcgataaatggctcgctttctttgtcaaaagctaaaataacgcaatctagttgtcccgactcaagttgttccacaagtaatgatgtttgtagttcataaatataaagctctaatctagggaaaagttgttttagttgaggaaaaattatcggtgaaatataaggtcctaatgttggaatgataccaatatgtaaggggccagacattactttaccttggttgcttgccatttctctaagaatcttcacttctcttaacacagtttttgcttgttcaactaaggtaagccctgattgggtaaagagtactttccggctagttctttccaatagcacagttccgagctcatcttctaacttacgaatctgcccactcagtgtgggctggcttacattacaagcatcagctgctttacgaaaatgtttaaaatcagctaaagcgattagatattctagatctcggatattcatataatattagtccccattaaatcaataattaaattatgccatatttgatgacaaaatattaatgttttaaatataccatagagcataacatcaaattacgctatctaaataatatttaccagcctaataacgaacaccctgcaagatcaacatataaccagcaatcaccaacaaaataccgcttaacagcctttgcattgtaagcggttttaaaatccctctcagcttcattgaaaagaaactggttaaaaatgaacatagcaccacaatagacacaacggtaaaattcacatatcccacttgccaagagttttctaaatagactggtggaattttgcttagataaccgtataagtttcctaatccaccaataatcatcatatagttgctataagcggcgatttgatgtggtttgacgcttggtaacaaactaataagaggtgccataattgagccaccgccaatacctgtaattcctgcgacacttccaccaaataagcacactgaaattcccttaatgttctcttttaacgagctacaagcggtggaattctcagatttttttgcgagaataagacataatgcaaggacaacaagtgtagtcacaaacactgcaacaattgcccaatttggaatgaaaaaactgatttcaaacccaagctgaacgccgataatcattccaattgaccacagcaacagagatttcattttgacaggaacacgttgtttatagaaatagactaaattgattgccgctgttcccattactgtcattaaagaggtcgccgcaaccatttgtaacgaaaattcaggaaacagtgtatgtaaaatcggcaccattaacacaccgccgccgatcccaaacagtgctgacattaaattagtcagtatgccacaggcgattaaaatcaaaattgtggttattgtcataaatgccctctaatatagaggtgttgaaagtcctacagcttctattatgaaagtgaaatctgctatcccattatgatcgtcctcatatttttccgagtgaaatttcattattttctaaatttgtgagcaagatcactttacagttatgacaattatcataatttatttacatctaacgagattatgctaaagctgttctaaatttctagaatagcaacttcataaactttatctgaaactaaggaggactatatgtttcttacgatagtcagttttatcatcgtaaccgctgcagtcggtttaatctcttggtataaaaccaaagatgatgatttaagcacctcaaaaggttatttccttgcagggcgtggattgagtggtgcagtcatcggctgctcaatggtattaacctcactttcaacggaacagttaatcgggatcaatgcaaactcttatgcaggtaacttctcgattatggcgtggacggtacaatctgttatcccactctgtttccttgcattatatctgttaccaaaatatatccgtaacggttacaccactattccagagttctttgaagcacgttttgacagacaaactcgtttgattatgtccacgctcttcttgttcttctatcttttcattgctattccaaccgcactttatacaggggcgattgcatttaataaaatcttcagcctacaagaagtgtttaatctcagctatggcgaagcgattacttacaccgtaattgcaatcggtatcatcggtgcaatttacgcgattttcggtggtttgaaagccgttgccgtatcggatacttggaatgcggtgatcttagtgatcggtgctttacttgtgcctatctttgcccttgcttatttaggtaacggtagcatttcagaaggtttacacattatcagcacaacccacgttgaaaaattcaatgctatcggtagtgccacagacgctgtgccttggccagctatcttcacgggtatcttaatcgtcaacttcttctactggacaacaaaccaagcgatagtacaacgtgcgttaggggcaagagatttaaaagcgggtcaaaaagggattttaattgcagcacttttcctcttgttgctaccgttaatccttaacttaccaggtttattgagctatcacattctgggcgaaggcttaaaaccgattgatgcctcatacccaagtttagtcaataaagtgttaccgacttggttacaaggcttctttgtggcagcattattcggggcgattttaagtaccttcaactcattcttaaattcagcggcaaccatctactgtaacgacttattacctgcgattaccaaagtaaaacgcagcgatgaagaacttattgcctatgcgaaaaaaatcggtaccgtaatggcgatcatcacaatgattgttgcaccgttattaatgttcggtacagacggtatcttcttgtttactcgccgttttgcaggcttctttaacattcctatcgtggcactctttgccgttggattgttcaaccgctatgtatcaggtttagcggctcgtattaccctattagctcacgttgtactttacttcactttagtgtgggtgattaatgtcaaagtgaatttcgtgtatgtaatgggttcactcttcgtctttgatgtagcgttaatgcttatcttaggtcaattcttaaaacgtgcgaccccatacgaagataaccaaatcaaccattcaaacgtggacttaacccactgggaatatgcaagaacagctgtggcttcattagtgttaggcttaattaccttacacttggtgttatcaccacttggtttagcttccgcagaaggtaatgcgacaatgattatgggcgtatgggctgtggtgcaagtgcttatcttgattttcttcggtaaaaagaaagtggtagataaagcgtaattaaaaagcataattaaagtgtaggggcacactgcgtgtgtccaaagaaagacaaatgtacggacacacgcagtgtgtccctaccctaaaataatggaatagcgttatgaacaacatcgtttacattcttttagaccaagtccgcaaagatatgcttggtccttacggacaccaaattgtcaaaacccctaaccttgacagacttgcggcggacggtattcgtttcaataatgcctttacgcctgcttctgtgtgtggacctgctcgaacatcattgtttacaggcttaatgccatctagtcacgggattattaaaaacggtgaaaaaggtggcacaggggaaatcagccaacaagcaccaaacatctgtaatttagaaggatacaactcttatgtcgtaggaaaatggcacgtcggcacaaaatctgttcctgaagattacgggattaaaggacacaattttgatggctacggttacccaggtagccaagtctataaaaatctagtgttcaaccaaccgccgacacactctaaccgttatcgtgaatggctagaagaaaaaggctatgaaatccccgaagttagccgagcttactttggcgataacccacatttacgtgtacaagaattgtgcggtttactttctggtacaaaagaagaaaccattgaatacttcatcattgacgaagcgaaaaaatatatccgcgagtcgctggctgaaggtaaaccgttcttcacttggatcaacttctgggggccacataccccttgtatcgtgcctgagccttactactcaatgtacgatccaaaagacgttgtgctagatgaaagtttcttcaaaccgcttgaaggaaaaccggggcatttccgcaccatctcaaaaatgtggggaatgtgggaagccagcgaagagagttggaaagaagtgatcacgaaattctggggctacattaccttaatcgatgatgccatcggtgagctgtttaccttcttggaagaaaacggcttatacgaaaacaccttcctcgttgccacagcggatcacggtgatgcaatgggtgcacatcgtatgattgaaaaaggtgagtttatgtttgaaaccacctacaacgtcccactgatcatcaaagacccacaatctaaccgtatcaatgaagttgatgacaatctcgtctatcttcacgacctcacctcaacggtctatgatgtcgcaggacaggaagttccgcaagagttccaaggggaaaccattttaccgatcaccagagaaaacaaagagaacgaccgcaaaggcttgctctgccaacttgcaggacactttgtttactttgaacagcgtatgtggcgacgcaaagactacaaactggtattcaacgccaccgacctttgcgaactctatgatgtccgtaaagatcctgaagaaatgcacaaccttttctatgatgatgcttataaggaaatcaaaaaagagatgctcgaagagatgcgtttggaaatgaagcgtctgaacgacccgcttgagaattgggtgtatcggattattgatgaaatttaaggccattaaggggttaacctgatagatataataaatagttttaatctggttaacctcttagatattttacagtattattttacagccaactccgctctcatctgatcaatcacagctttataatctggttgatcgaaaatcgcagagcctgcaacgaacatatctgcccctgcttctgcaatttcagcaatgttattgactttcacaccgccatcgacttccaagcgaatgttaaatccactcgcatcaattcgacgacgagcttcacgcaatttgttcaaagtagatggcaagaatgcttgtccgccaaaacctggatttaccgacatcaataagatcacatcgactttatccatcacatagtccaagtagcttaatggtgttgcaggattaaatactaagcctgatttacagccgtgttcacggataagttgtaatgaacggtcaatatgctctgttgcttctgggtggaaagtgatgatgtctgcccctgcttttgcaaaatcagggattaagcgatcaacgggttttgccattaaatgtacatcaatcgggcaagtaatgccgtaatcccgtaaggctttgcaaattgcaggaccgaacgttaaattcggcacatagtggttgtccattacatcaaaatgaattaaatccgcccctgcttttaatacttctgccacatcatcacctaaacgagcaagatccgcagataaaatagacggagcgattagataaggttgttttgccattgtctgatctcctacttacaaaatagcaatagcctagcatatttatcgcgaagaaacttagatccagttcgcaatttcgttatttccttgtgtttaagttgaaaaaagtgacaaagaccataaaaaaattatagcttttttattttgtttcaggcaaaataatcccgtatttaatttatggttttaagtctgagtttttgactaggagaatatatgaaaaaagggattcaccctgaaaattatcgtgaagtgttattttacgacggtagtgtgcaacaaggctggattatccgctcttgtgcggcaaccaataaaacaatggtatgggaagatggcaaagagtatccgctttatccattagatacgtcttctgcttctcaccctgtttatacgggtaaacgtcgtgaagcgaatactgaaggacgtgcaagcaaattcaatgaacgctttaaaggcatttcgagcttaacgaaaaaataagaaataaaaggggacaaaatgaaaattttaaattcgcttaaatcagcgaaatcacgccacccagattgccaagtggttcgtcgtaagggtaaattatatgtgatttgtaaaacgaaccctcgctttaaggcaagacagcgttaagaaaaatcattataaaataaaatatatagcggtgagaatgaaatcatttttaccgcttttttattgattattgtcaaataacattcataaaatgtattttgtttgcattttttatgttttataaatgttacaatcattaacatcaataacctatccattgagtaaactatttttggctaattttacagaaacgactttacctcgccgtagctttttgcgtggacattttttgaaatcacttcaggacgaaaaagtggctcagcaagggcatcaagccgttcgagcaccttggactgatcttgcaaatttttttgataaatgcaccgcttgcgataagtgtattgccgtgtgtgaaacacaaattttagtgaaaggggctggcggttatcccgaagtcaattttatgaatggacggggggaatgtactttttgtcaggcgtgtatgactgcgtgtgaagctggtgtgtttcgttcaacagatgagcgagcttggtttcattatgttgaaattcagcaaagttgtatggcgtttagcggtgtggaatgccgtagttgtgaagatagttgtgaaagccgcgctattcgctttaagcgacaagtggggcgagtggcaatgcctgaattaaatgtggaaagttgtaatggttgtggggcttgtatggcagtttgtccgacacaagcggtcactttggtgagaaatgttgcaagcccgttaagtgaatgaaatgagaaatgtatctgataaattgaactacgatgaagcggacaactggtatgtttgtagccttgtagttcaagtgaaacctgaaaagttggacttggtgaagcaagccttaactgagttaccgaatacggaaatccacggggtgaaacttgaagagagtaagctcgtggttgttttggagtccagttatcaacctgatttggttgatcgtatggagatgattaaagatattgaaggggttatcgtggtgtcgctgatttatagccaccaagatgaaacactttaatttggtattacctattattttgtggggaatttatggaactcaatcgtcgcgattttatgaaagcaaatgcagcggcagcagcagctctcgccgcaggtattacgttacctgtgaaaaatgtgtacgctaacgacaatagcattaaatgggataaagcaccttgccgtttctgcggtacgggttgtagcgtacttgtgggtacgcaaaatggacgtgtggtcgcttctcaaggtgaccctgatgcggaagtaaaccgtggtttgaactgtattaaaggttacttcctgccgaaaattatctacggaaaagaccgcttaacatcgccaatgttgcgtatgaaagacggtaaatacgacaaaaatggtgaatttacccctgtttcttgggatcaagcatttaccattatggcggaaaaattcaagaaagcgattaaagagcaagggccaaatggcgtgggtatgttcacttcaggtcaatcaacgatctttgaaggggtagcaaaatctaaactgtttaaagcaggcttgcgttcaaataatatcgatccaaatgcacgtcactgtatggcttcagcagcggttgcgtttatgcgtacctttggtatggacgaaccaatgggttgctatgatgatattgagaaagccgatgcatttgtgctttggggatcaaatatggcggaaatgcaccctatcttatggtcgcgtatttctgaccgtcgtttatctaaacaagatgcgaaagtggcggtactttctacctttgaacaccgttcttttgaacttgcggacttgcctatcgtatttaaaccacaaggtgatttagcgattatgaactatatcgcaaattacttaattcaaaacaatgcgattgaccaagactttatccaaaaacacaccaaattcaaacgtggtgaaaccgacatcggttacggtttgcgtgataaccacccattagaacaagcagcgaaaaatgcaaaaaccgcaggtaaaatgcacgatagtagctttgaagagttcaaacagctcgtttctgaatataccttagataaagctcacgaattatctggcgtgccaaaagatcagttagaaagccttgcgaagatgtatgcggatccaaatttgaatatcgtttcattctggacaatgggctttaaccaacacgttcgtggcgtgtgggcaaaccatcttatctataacattcacttactcacaggcaaaatttctaaaccaggttgcggacctttctcattaacaggtcagccgtcagcttgtggtacagcacgtgaagtaggaacatttattcatcgcttaccagcggatttagtggtgactaaccctgaacacgttaaaaccgcagaaaaattatggaagttaccaaacggtgttatccaaactaaagtcggcttgcacgctgtagcacaagaccgtgcattaaaagacggtaaactcaatgcttactgggtaatgtgtaacaacaatatgcaatgtggtccgaatattaaccaagagcgtatgccaggctggcgtgatgaacgcaactttattgtggtatcagatccatacccaacagtttcagcactttctgcagatttaattcttccaacagcaatgtgggtagaaaaagaaggggcttatggtaacgcagagcgtcgtactcaattctggttccaacaagtgaaagcaccaggcgaagcgaaatcagacttatggcaattagtggagttctctaaatacttcaccacagatgaaatgtggccagcagaagtattagcagcaaaccctgaatataaaggtaaaacactatacgacgtgttatatcgcaatggtcaagtggataaattccaagtaccaacggataaagctgattacatcaatgatgagtcaacccattttggcttctatttacaaaaaggtttatttgaagagtatgcggcattcggtcgtggtcacggtcacgatttagcagactttgaaacttatcataaagcacgtggtttacgttggccggtcgtggatggcaaagaaaccttatggcgttaccgtgaaggctatgacccatatgttcaagctggggaaggcgtatctttctacggcaataaagataaacgtgcagtgattttagccgtaccgtatgaaccacctgcagaagcaccagatgcagaatatgatttatggttatcaacagggcgtgtacttgaacactggcactcaggctcaatgacccgtcgtgtacctgaattacaccgttcattcccgaataacttagtgtggatgcacccaacggacgctcaaaaacgaggtttacgtcacggcgacaaagtgaaagtaatttcatgccgtggtgagatgatctcgcatttagatactcgtggtcgtaacaaagtgcctgaaggcttaatttacaccactttcttcgatgcaggtcagttagccaataaattaaccttagatgcaaccgacccaatctcaaaagaaaccgacttcaaaaaatgtgcggttaaggttgtgaaggcttagccaagaacacttcccccacctgtgggggaagtggttgagcgaagcgaaaccgatgggggcatagttgatatcccccatccccgcctgaggcggtacttcccccataaatgggggaagaatatcagataccccgtaagcggttagatttgagcaacaatttgcaaataaggaacaggcattgaaactcgatccaaatcgtcgccaatttttaaaaaatgcgacacgcacggcaggcggtgtttgtggtgtggggatcatcttagccttacaacaaaaccaaagccttgctcgacaaggcgtggcactgcgtccaccaggtgcattagccgatgataaagatttcacagccgcttgtgttcgctgtggacaatgtgtacaggcttgcccttacgatatgttgcatttggcttcattgctatcaccaatggaagcaggaacaccttactttatcgctcgtgataaaccgtgcgaaatgtgtcctgatattccttgtgttaaggcttgcccaagcggtgcgttagatccaaatttaacgaatattgatgatgctcgaatgggtttgtccgttctgcttgatcacgaaacctgtttgaactggcaaggcttacgttgtgatgtgtgttatcgggtttgcccgttaattgacaaggcgatcacccttgaaatgcaacgcaacgatcgtacgggtaaacacgcaatgtttatcccaacggtacattccgatgcgtgtacagggtgtggtaagtgtgaagaagcctgtgtgttagaagaagcagcaatcaaagtattgccaatgtcgttggcaaaaggcatgttaggtaaacattaccgacttggttgggaagaaaaacagaaagcagggcattctctgcttgatgaaaccaacccagaaggcattatttccttaccaacacgaatgccagaaggggtgaaataatggcaaattccccgaaagacgcagggcttgaagcccgacaaaaattaggttggtggcgtgcttatcgctttttaattttacgccgattaagccagctcagtgtggtgttgatgttcttaagcggtccgatgtggaatgtgtggatcttaaaaggcaattacagctcaagtatgctgtttgatcttatccctttaaccgatcctctgattaccgcagaaagccttgccacaggctatttgcctgaatggaaaaccttactgggtgcagcgatcatcgtggcaatatatgcgttactcgcaagcaaggtattctgtggctggatttgccctgtcaatatcgtcacagactgtgccgcttggctacgacgaaaacttgggatccgtcaatccgctaaattaccccgttcattacgttacggtattttagcaatgatcttagtcggatcagccatttctggcacattattatgggaatggatcaaccccgttgcagcacttggtcgagtgttcgtctttggtcttggtgcaacgctttggttagtgttagcggttttcttatttgatttattgattgtggaacacggttggtgcggacatctctgtccaatcggagcagcctacggtttaatcggtgcaaaaagcattgtacgagtaggggttgttgatcgtgcgaaatgcgatcgctgtatggattgtttccacgtttgccctgaaccacaggtactacgcttacccttaaatggtaaacccgaagatagccaaatagtgttatcgaaagattgtattagttgcggacgttgcgttgatgtctgtgcagaaaatgtatttagttttacaacacgttttgaacgtgaacggagtgaaaaatgaaaaaatatctcgccctattattaatcgcagtaacaggtgtggcttttgcgaatgtagaaaaagtcccgtcaagtgcagagcaaggtgttgaagcgattgaacctgctttccacaatatgccaaaagatgaaggaaagttaccgcttagctatgtgaaccaacccccaatgatcccacatagcattaaaggctaccaagtgaccaaaaacaccaaccaatgtttaaactgtcacggcgtagagaactatcgtaccacaggtgcaccccgcattagcccaacacactttatggatcgtaacggcaatgtgactggtgacacatcaccacgtcgttatttctgcttacaatgccacgttccacaagcaaatgttgatccaattatcgaaaaccaatttgaaccgaccaaagcatttgggggtaaataatgtttaagctcatcaaaaaattttggacgtggtttaaaaccccaagcaaaatcggcatcggttttctcattgtcgtttctgcgatcggcggtattttattctggggtggatttaacacagcattagagcacactaatacagaagagttttgttcaagctgtcatatgaatgatgttgttcctgagtatcgagcatctgctcactactcaaaccgcagtggtgttaaagcggactgtgcagattgccacttaccgcacgaatttattccgaaatggacacgcaaaattgtcgcatctcgtgaagtttttgctcatctaacaggcaaagtggacaccaaagagaaatttgaagcacaccgcttagaaatggctcaacgtgaatgggcgagaatgaaagccaacaattcacaagagtgccgtaactgccataacttcagcgatatggacttcactcagcaaaaaaatgtggcggcaaaaatgcacgcaatggctgaacaagaaggtaaaacctgtattgactgccataaagggattgctcaccagttgccaaatatgcacggggtgaaatccggtttctcttcagagaaataagagatacaagcggtgagatttgtaaaaaaatttgcaaatttgaccgcttgtttattccccacgataacgtttagtaaatttttgttgatgtctagcaatcacatcttcaatcgcaatatcgtatttatccgctaagataaataagttatcaaacacatcgcccaattcttcgattaaattttcttttttctgcaaggcatcttgctcaatttcatcagggcgttctcgaccaatctcaatagcacgcacggcacaggcaacttcgccaatttcttctgtgagataagcaaggcgacgaaaaacatctcgctcgtaccaattctgctgttgataaaattccctgacccatttttgatattcttgaaagtgcattttgttctctctcattatttgttaccatctgccactactttaacaaaataggaagaaaaagaaatgaaaataaccgtctattgcggagccagtgtcgggaataatttggctcaccaacaagcgacgattaaattgggtaaatggattgcagagcatcaacatacgttagtctatggtggtggtaacgcggggttgatgggcttattggcaaataccgtgttggaaaatggcggtgaagtgattggtattatgccaacctttttacaggaaagagagttggcgcataaaggcttgacgcagatgataaccgtcaattctatgcctgaacgtaagagcaaaatgatagagttaggtgacgcttatattgcgttagcgggcggaccaggtacattagaagagatcgctgaagtgatttcgtgggcgagaattggtcaaaaccccaatccgtgtattttgtttaatagtgatggctattatgatgatttaaaagccttttttgacaatatggtaaaacaaggctttctcactcaaacggatagagacaaaacactgttttcagataatttggtagaaattgaaagttttattcaaagttatactccaccaaaagtgagagtatattaattgtctgggagatatttaacagttttctttataggcaggctaatgtttctcgagagggaaaaatggcatagtagacaaactggccactaaaaaatggcttaaagccttatattacagactttaagccacttttttgaattatgaaccaaaaaaaatgtcatttttgccacagtagcgacattcgcaagcatggtataagaaataatattcaacgctataaatgtaatgcctgtgataaaacatttacccttaaaaagaaattaaatccaccactatcacgttatttaaatattattgcggataccaccttctttggtcgtgaatttggtgttttagtcctgatggattcgctttctaaaaaagtggtttaccatcgtgttattaaaacggaaaaagatgtttattacaggatagcatttaattcacttcgtatgaaaggctataacattcaatcaattacctgcgacggcagacggggtatattgaaagatttattggatacaccgacgcaaatgtgccattttcatatggtagcgattgtgatgagagcattacgaaaaaagcatcaatctatagctggaaaagaattaaaaacaatagcattaacgcttaaacagagttctaaaaaagacgtctatttacgattacatcattgatatttaaaacataaagcgtttttagaagaacgaccaggtaaaccgaatgaaaagggctattatccttataaacatagaaatgtaagaagtgcttatcatagttttaaacgttatatggattatctatttacctatgaaaagcatggcgatttaaatatcgaaaaaacgacaaatagacttgaaaacttatttgggcaactaaaggaaaaattatcgcatcatacaggattaatgaaaagacataagattatgtttataaaggattttttaaataaaaagagttggtaagaattagggaaaataattaaaaccaacacttttgtctactatgccgataattcattttttgagcttcttgtgagtgtttttgcaattatttttaattctttacccgcttgtgattgatgtttttttcttaatttcctcatcacaattgccaccatatgaaactgacacatctgtactggcgtattaaataaatctttcatcaaaccacgtctaccatcacagacaattgattgaattatatagtctttttctcttaacccattcagggcaagtttgtagtaaatatctttttcggttcgcacaaaataatgggaaatgacgttgtttgaatttgaatccattaacaccaatacaccaaaataacgaccgaagaatgttgtatccataatgatattcagatgtcgatttaaaggcggttttaaagatgttttaggggctttatcaatatatctttgaatcgttctgactgaacaatgatatttaacggcaagttgttgataggtttgttttccagatgtgtaatcagtccaaattttaattgggtctaatttatttttgaaggaaaaggttttatggcatttatgacaaaaatatcgttgaatattatttgatgtaccatgtttctttattttcagactttggcaaaatgggcagtttttttgttcatatttcaaaaagagggcttaaacccttgtactataaggcgttaagcctctttttagcaacaaatttgtctattacaccgatttattactgcccataatacgcattcttaccgtgtttgcgtaagtaatgcttgtctaacagctcttgttgcattgaaccaatattcggacggatttggtggctgacaaaattcatataggcaacttcttctaatactactgagttatgcactgcatcaaatgcgtctttgccccaagtgaaagggccgtgagagtgaactagcacgccaggtaccattgatggctcaatcgcacgtttacggaaagtttcaacaatcactttacctgtttccaactcatattcgcccgcgatttcttctggggtcatacggcgtgtgcaaggtactgagccgtagaaatagtcaccttgtgttgtgccaagtgccaaaatatcttcccctgcttgcgcccaagcggttgcgtgacgagagtgtgtgtgaaccacgccgccaatttcagggaattgacgataaagctctaagtgtgttggggtgtctgaagatggttttttcgttccccaaacacgattgccttgtaaatcgacaatcacaatatcatcggctgtcattacatcgtaatctacgccagatggtttaacggcaactaaaccagactcgcggtctatttcactcacgttaccccaagtgaatgtgactaatttatattttggtaattctaaatttgcttttaaaacacgttcacgcaattcttttaacattcgaagcccccttctttcattttttgttcaatccaacggcgagcattgatgatctcagcaatcggctcttccgctttttctgtccacatttcaattaaaaatgccccacgatagttcaattctgcaaggtttttgaagcaacttacaaaatccacacaaccatcgccaaacggcacatcacggaattgacctttgcaggtttcagtgactttgtaggtatcttttaagtgaatagccgagattttgtcgatacctaatttaagctcttcagcaacattgtcgttccacgcagagagattgcctaaatcagggtaaacggtaaaccacggtgatttgatgatctcgtcccattttttccaacgggaaatcgaactcataaatttagtatccataatttcaaccgcaatggtcacttggttacttgccgctaactcaaccgcccactctaaaccttcttggaaacgttggattgtgccttcgtcttgttcttcgtaatagacatcatagcccgcaagttgaatggtgcgaataccgagatctaccgctaattgaattgccttttccataatttcataggctttttggcgagtagcttcatcacggctaccaaacgggaaacggcgatgtccggataggcacattgatggaatggttacacctgtgtttacaatcgctttgacaagttttaaacgctcttttttaccccaatcaaggcgagcaaggcgttcatcagtttcatcaatggaaatttccacaaagtcaaaaccacaggttttggcgatagacagtctgtcttgccaactgatatttttgggtaaggctttttcataaatacctagtttatgttttctcattcttaacccctttggttaaatgtaaaatatgtgaaggttgtagccgcttgccttctgatttgttagggcggacacatcggtccgcccctacaataacatcaggatttctaagccaaaatcacttccaaccctttttctctaagttgtttaatgatttcaggatcagcttcagaacctgtaatcaaaatatcaattttgctcagttcactaaataacattcctactcgtttacctagctttatactatctagtagcacaacatatttctgagcttttgacgacatctgattttcagagtgggcgataatcatatcggttttatataaaccttctagcgtaaaacctttcccactcgtaaacataatatttgccgcatagctcatctcatttccactgatagacaatgtaatcgctttatttttattatattgtccgccaagaataaccacatcatcgtggttatgatcaatcaaatgatttgcaagcggtaaatagttagtaataatttgcaaacgctgaccacataacctgctacctagcatcgacattgtagaaccgcaagttaatacaacgctatccccttctttgcacaatttgctagcagcttcggcaatgcgttgcttttcatcattatttttaatttctctattcgatggaataaagcctacactaatggcttctgcaccattacggactttatgcaaacgcccttgttcacttaacttattaatatctcggcgtgctgttgcaggggaaatatctagtaattcaataatctcttgagttgaaagtacttttctttctgttaaaagatcgagtaattgccgatgtctataattttcgttcattattcatctccttattttatgattattttaaaccaaataatgaacaatccccccattttactgggggggaattgattaagattaaagcattgatttgaattgaatatttggttcttgctcgaagcagtcatcaaaaccacgagggtggtgatattcaattaaatctttatcttgtgggtaaacatatttgccaccgacttcccaaatgaatgggtggaatttgtattgtaagcggtctttacgcatacgccataagtcaatgatctcttgggtgcttgccataaagtttgtccagatgtcgtggtgaactgggataattactttacaacgtaagcactctgccatacgaagaagatcgattgatgtcattttatctgcgatacctactgggttttcaccgtagttgtttaatgcaacatcaatatcgaactctttaccgtgttttgcaaattgaatagagtagtgagagtctgcaccgtgataaatgttaccgcctggtgttttgaacacatagttcaccgctttacgacccatttcttcatcagatgggcataaacctgctaattcaccgccttgagcttctacaccttcaacaggtaaggtaactaaacaggtacggtcgaaagagtctaatgcgtgaatttcaacgtcttttaatttcactacatcgcctggttttacaatgatgatacgctcttctggcacgccccattttttccaaagctcagcacagtgccacggaccaacaaatttaacgtgatctaattttggattatttacaatcgctgctgccacgttcacatcaatatggtcactgtggtagtgagaagcaagaatgaagtccacttcattaattgcaaatggatctagcaccataggctgagcgcgtaagtttggctgtaatttacgaacacctgacatatttgccatttggtgaccacgcaccatatcttttactttcttggtgcttttaccgcgaccacaccataagtccatacaaatgtttgcacctgctggggttttaatccacacgcccacacagccaagccaccacattgcaaagttaccttctggaacgacttcattttcgatctcttcatttagccaagtaccccattcagggaaggtagaaagaatccaactttcacgggtgatttctgaaattttgctcattgttagctcctatgattaacaaagttaggaaagaataaaataatcacaagtaatcataaccaatcacagaaaaatgtacactcttttttgtaattttgtgatctatatctaattttttatgtaaacgttatttattgataacctttgtcatctacaacatattgaaaaacatagaatatatttataagagtaacgtttttattaacaaaggcatattttgtccacctcacatttgtaaaaaataacaacttttctttacaaaaataatgtgacatagttcgcaaataatcaaattcaatcttttttagtcgtatgaaattgctattatgcacgatgttaaattcgtgcttatcagaatttcgacgctcagcgttaagctgagatcaatttttctccatacatattgataaataagaggtactcttatggaaatgctcacagatatcctgctctttttaaaagatcaggtgttaaataaagcaccattcttacttggtatcgtagcttgcttgggttacattcttctcaaaaaagacaccaccaccgtgattaaagggacaatcaaaaccatcgttggttttatgattgtacaagcgggttcgggtttccttgtaaccaacttcaaacctgtcatcgaaggtttatctaaattccataacttaacaggtgcagtaatcgacccttacaccagtatgcaagcgactattcaaacaatggcagacaactatgcatgggtaggttatgccgttattggggcgttaattttaaacgttttactcgttgtgtttagacgctttaccggtattcgtaccattatgctcacagggcatattatgttccaacaagcaggtcttgttgcggtgttctatatgatcatcggtgcttctatgtgggaaaccattatctatacttctgtgttaatggcactctactggggtatctcttctaacattatatataaaccaacacaagcggttactggcggtgcaggtttctctatcggtcaccaacaacaaatcgcgtcttggattgcagtaaaacttgcaccgaaactcggtaacaaagatgactcagtcgatcatatgaacctaccaaaatggttacatatcttccacgacagtatctctgcaaccgcgttagtaatgacaatcttcttcggtatcatcttactttcattcggtttagataacttgcaacaaatggcaggtaaaacccactggtttatgtacattcttgaaatgggcttgaaatttgcagtagcaattcaaatcatcgtaactggtgtgcgtatgttcgttgcagaactttcagaagcattcaaaggtatctctgaacgtttaatcccgaactcagtacttgcaatcgactgtgcggcaatctatgctttctcaccaaatgcaatggtattcggctttatgtggggtgcaatcggtcaattcgtagcggtaggtatcctattaggctttggctcaccaattctcatcattccaggctttatcccgatgttcttctctaacgcaactatcggtgtatttgcgaaccaattcggtggctggaaagcggtaatgaaaatctgtttcgtgatgggtatgatcgaagtattaggttctgcgtgggtaatccaaatgttagcaagccaaggtacaaccttcaacggttggatgggtatggctgactgggcattattcttcccaccaatcctacaaggtatcattagcgtaccaggcttcttcttcatcattgttgctctagcgatggtttatatgttcttcgcttctcgcaacttacgcgctgaagaagcagaagctgcagcaaaaggcttaacacttgaacaattagacggctacggcttagatgaagttcaaactcaacaagaaacaaaagtagaagaaaaagcagaagtatcacctgctcaaagtgatgcaaaaccagttcgtatcttagcggtatgtggctcaggtcaaggttcatcaatgatgatgaaaatgaagatcaaaggctacttagataaacgtggtatcccaaatattatggactcttgtgccgtaacggactacaaaggcaaattaaatgaaatcgacattatcgtttcatctcaacacttagcagcagaaattgaagtgccagaaggcaaagcattcttaggcgtgaaaaatatgttaaaccctaactcattcggtgatgaactcgttgagttaatcaataaacataacgctaagtaacctagtcaatccccccttttcaaaggggggaatttatccaagaggtgtacaatgaatttaaaacaatctttaattgaaaataactcaatcaaacttcatcaatccgcaagcaactgggaagaagctatcaaaatcggcacagacttacttgttaccgctggcacaatcgaaccacgttattacgacaatattgtaagcaaaatcaaagagatgggaccttacatcattctcgtaccaggtttagcaatgccacacgctcgcccagaagaaggggtaatcaaaacatcatttgcacttgttacccttgacacaccaatctattttgaaggtgaagacgagcctgttgatgtacttttaacccttgcaggtagcgactcagatcaacatatgcaaggcttaatggaaatcacccaagtgcttgatgatccagatagcgacacaggcgttgatttagataaaatccgccgctgtaaaaccgcagaagatgtgtatgctgtgattgatgcagcattaaacggctaattcatacaagcggttgggaaaacgttgtttttggtaaatattcagcacacaagagaaatgtagggacgccacgcttggcgtccatttcccaaatatagtaaagatgatatttaaaggacgccaagcgtggcgtccctacaatgttgttttaatatttatatagtttcgctatttctttctcaaatctaaccgcttgcaaccctaatttttaatctttaaaaggaaaataatatgtcaaaaccacttctccaaattgcccttgactctttaagtttagaaaaagccgtcgctgatgccaaacaagcagaagatgttgtcgatattatcgaatgtggcacaatcctagcttgtgcagaaggtatgaaagccatttcaacactcagagcattacacccaaaccacatcatcgtatgtgacctaaaaaccaccgatggcggtgcaatccttgccaaaatggcatttgaagcaggagcagactggctaacagtttcagcagcggctcaccctgcaactaaagcagcttgtaaaaaagtggcagatgaatttaatgccgctcaccctgaattaaaagtgaaaaaagaaattcaaatcgaaatctacggcaactggaccgttgaaaaagacgcacaagagtgggtagatttaggcgtgaaacaagcgatttaccaccgctcacgcgatgctgaattagcaggaaaaggctggacagcagaagatattgaacttatgaaacaactttctgcaaaaggtttagaactatccattacaggcggtatcgttcctgaagaaattcatcttttcaaagaagttaaaaatgccaaagccttcatcgcaggtcgtgccttagtcggtgaaaaaggtaaagcaaccgctgaagcaattcgtgcggaaattgataaatattgggcataataccgttattatctttaatggcaatatagtcaaatatattgccttttttacatccatcatttatcctaaccgcccaattcttaaaaataaaataggttatctaaagtctacaatagcccttccttttaataaccctctgctacctactgatttgaaagatattatcggaataaataagaactttaaatcagaaacaactttaattagattagtatttttttctaaaaatatgctttaatatgtaatgttattattggtacataaattaaatacaaatatcctataggagaatgtataaaaaccattttactgttaaacggccccaacctaaatatgctcggaaagcgtgaacctcatatctacggttcacaaacgttatctgatattgagcaacatttaaaacaacaagcagaagcccaaggctttgcgtttgactattttcaagcaaatggtgaagaacctttgattaatcgcattcatcaaagcttccaaaaagttgattttattattatcaacccaggcgcatttactcacaccagcatcgccttgcgtgatgccttattatctgtcgctattccttttgttgaagttcatctatccaatgtacacgcccgtgaacctttccgtcatcactattatttaagtgatgtggcaaaaggtgtgatctgtggcttaggggcaaaaggttacgactatgcgttagattatgcgataagctatctaaccccctcttcatagctaattattaggaataatccacatattgaagtttacaagtggaaaaataaacctcattattcacaaaatttaatctaaccaaaggaggaaaatgaatgaaatggtttattcacgcactaaaaaacagctttaattttaagggcagagcaagacgagcagagtatggctggtttatcttaatcatcattcttattgatctctgtttttcattatttagctcagctgcaactgtattacgaatgtttagtttggcggaactgctcaatggattaaatctattgtttggattgattttgattattccatcaatcagccttgttactcgccgtttacatgatctaggttgttcaggttggtggcaactttgtcagctagccatgtcaattgttctagtcattgcaggatataatattgaagatgtcataaacaatcatttttcaacgctgaaagcagttgttattattgtagtattaattatcactgttattttctatctgttactcttcttcattgacggagatcgttttgaaaataaatacggtgcggatcctaaagctgttgtagatttgtaagcggtactgtcagaagaaaaatttaaccacccatagcaatgatgaccacatgaaagtgatacgtttggattgatgtattgaatagccctctacatctatcatttgcaatagatttaattaaaagagggcttaaaactttgcactataaggatttaactcttcaacaacacttttttctactatcaaacaaaatggttagcctttatagactatacgcttgttaatatataattaaaagattgtatattctgagtttcttttttatatacatatttatcccttccaataacgagtctcatccatttcaaaattccctctaatcccccaaaacgttgtattgatgcaagtgattgaaaatggaatacctttttcttgagatgcagaaaccaatgattgccccttaaaacgtacctgataatatccattatctacctgaatcaactctgcatttgcgaattcgaacccctcttttttatctacttcgatactcaaactgccattatcttcaatatcagccagaataaagagatcttctccaaagaacttaaatgattgtgtcgaaaaatgcattggtttagctggatctcgagcaaccatccctgcaagtctatctttatctacaaatgcaagccctagtccactctctcgccaacctcgatgtcgacctttccctcccatataataaatacggttatctcctgccgtcatggacgatgcaaatattgttgcactatcaaactccccatcaaggtatttctctctgcctgctccagcaggaatcaatatattatgttcaggtacagctttgttccattccgtcaaatttgtagaccagtacagttctaaattcaaagtatcaaaatccatcactgaattgtcaccttgtttataaatagatgccagtcccaaatagatatcattatattcaaataccgtcatagagtaagtttgttcaccatacccttgacctcggatcacctcttccaatggtgaccagtgaataaaatcatcactgcgtgagatagccagaacccgaaagttacttgcctataaacgagtagtcagcacatattgattagtacgactatctttaaaaacagagttgtggcaatcagctcccaaaattgggctattttccttccactcaactaacggcgagaaatgtataccatctgctgagaaagcaaccgccattttcttattatcttctttacgagtaattaatttaaaacgtttatttggatcaacttccgttggttcatataaaatacctgttcctgccacatctcgcataataatattgttctctttactcccttcaaaatccacgatgcccaacttaggtttttcccacaggatgccatcattagaacgtgcataagctagccctacttgacgatctttagtgctatattgagcagaatgacgcttttctcgaggtgtagaacgtgaagagggatccacaacaaacaaggtgtaataacaatgataaacccctttttcatctattcatattatgcatttttaaaccatgataaattcctgtatcaaaggcaaaatagtgttttaagtgacgtttaggggggcgaatttcaaacacagcagaacgtactttaaaccctgctgaattcgcaatagatggtgtgatagctagagctgcagctccacctaaccctaatagaagagaacgacgagttagatttaacatataacctcctgataaatgaaagaagctataccataataaattatagataatcctctcaatatcaataagttataaatgtgaactagatcacaagaatttacatgagtagatatctacactaaaaatggctttctcctttcgtctaatctcaactctagtaaaattttatctcaatctcaccgcttttatggggtacaatacactattctcattatacttaacttatttaaaatgaaagaaaccattgttgcacaagctacccctattggacgtggtggaattggaattttgcgagtatctgggcctctcgctacagaggttgcacaagcggtcttaggtaaatgccctaagcctcgtattgctgattatcttccttttaaagatgaagatgggacagtgttagatcaggggattgccctctttttcaaagcccctcattcgtttactggggaagatgtccttgagctacaaggacacggcggacaagtgattttagatctcttactcaaccgcattttaaaagtaaaaggggttcgtattgctcgggcaggagaattctccgaacaagcctttttaaacgataaactcgatcttgcacaggcagaagccattgcagatttaattgatgcaacctctgaacaagcagctcgttccgctctaaaatcattacaaggtgaattttccaataaaatcaatgaattggttgattctgttatctatttgagaacctatgtagaagcggcgattgatttccctgatgaagagatcgattttttagttgatggtaaaattgaagcaaaactgaatgagatcatcgctcaacttgctaatgttcgtcaggaggctaagcaaggtacaattttgcgagaaggtatgaaagttgtaattgcaggtaaacctaatgcgggcaaatctagcttactcaatgcgttagctggtcgtgaagcggcaattgttaccgatattgctgggacaacccgtgatgtgttgcgtgaacatattcatattgatggaatgccgttgcatattattgataccgcagggttgcgtgaagccagtgatgaagtagaaaagatcgggattaaacgtgcgtgggacgagattgaacaggctgaccacgttttattaatgattgatagcaatgaatctcaagcggatagtttccaacaagaatgggcgacatttttagcgaagttgccgaaaaacattcccgtgactgttattcgtaataaagtggatttaacaggagaagcagaaagtttggttcaagcagataatttcactgtgattcgcctgtcagcacaaactaaagtcggtgtggatttattacgagaacatctaaaaaaatcaatgggttatcaaagttctactgagggtggctttattgctcgccgccgtcatttagttgcacttgaaacagcggcagaacatttggaacgaggacacattcaattaactcagttctatgcaggtgaattattagcagaagaacttagaatggtacaaaatgccttaagcgaaatcacggggcaatttacctcagacgatttactcggtaatatttttagttccttttgtattgggaagtaattatcggcatagtagacaaaagtgttggtaaaaatggcttaaagccttatagcacaaggctttaagcccactttttgaaatatgaacaaaaaaccgtcctttacaaactcgcattgaacatacttcgtgaaaaaagccatagaattcaatccattacaaatggtggacgtagagggctattaaaggatttatttaatacatcaatccaaaagtgccattttcatatggttgcaattgtgatgagaaaactaacgtaaaaagcatcaatcacagtaagtttctactatcatcccccacccttcctacaacaaaaatcaaaggctttggtaggcagaatgcgtcttagccaccaaaatagtttggttgggaaggtcacttgatagcgtgctttgggctgtttggcattgagtgcgtctaaacaaactttagcgcattcaatggctggtagcgtaaaggggttggcatttcctttggtatttaggcgtgccaactgttgctgataggcttctttgtggaatgaattttctatatcaatatattgctgtaatttcaccacagaattagggcggaatttgctttgaatagggcctggttcgatcaggctgacatagatattcgagccgtgcaattcgtggcgaagggtgtctgccataccttctaaagcaaatttagtgctgttgtaagccccacgaaagtgcattgcggcaaagcctaaaatgctactgttgattaaaatccgtccgtgattttgttggcgaaatagctttaaagcgtagttcatcacttcccacgccccaaatacgttggtttcaaaaatttcacgcaaggcttcacggggaatgtcttccactgtccctggctgtccataacctgcattgcaaaaaactgcatctaaaccaccgctttgttgaatataatcaaagacttgggcaatttgggctgagttagtcacatcaagttcaacacattcaaagccttcaaattgcagacgttgtacatcttcggctttgcgacaactggcaattactcgccagccttgttgtttgagataatgggctgttgcataacctatgcccgacgaacagcctgtaattaagatagttttcattgtgttaatccgtttaaccattgaacaaagtcacctgcctgcataaaacctgtcacacgagattggctcaattccctgccttgctcatcaaagaaaaggatagtcggcaagcccagcacttgaaaatgcttcatcaattcatcattttcacgggaattttttgtcatatcgatctgcaacactgccatttctgccaatttcgcctgcacctttggatcaacgaaagtatatttttcaaactctttacaagctacgcaccagtcggcatacaggtcgagcatcacttttttacctttgttagcggccagttgttgctctaattctgcaagggagtgaatgcgtttgaaatggttgctttgggtttggtttgccaacgtaggttgccacgcaagatctagccaaggtttgctcgcaactaccaaggttgccaatacaagcaaacgaagcacttttttccagccgttcaaactattgcactgctcatttagccagagtaaaaaggctatcgccagagccgaccacagcagtggctcaataaaagtaggtagcacacgagagagcaaaaagacaggcagagccaacattacgaagccaaacagcgtttttactttcagcaaccaatcccccgattttggcaaaatgcggttgccgaaaagggtcactaacatcagtggaatgcccattcctaaggctaataggtagagagctaaaccgcctgtcagtaagtcaccgctttgtgccacatagagcaatgcaccagataggggtgctgatgtgcaaggggaagcaactagccctgcgatcattcccattacaaatacgctaaaaaacgatccgccctgttgctgttggcttagttgatttaatttttgttgccaacggtgtggaagttgtagggtaaagagaccaaacatcgacattgcgagcaaaataaagagcaacgaaagcccaatcagtacaggcggactttgcaaagcgacttgaaaaggtaagccaatcgccgcaaccagtagccctaagagcgtgtaagtgactgccattccttgcacatagcttaaactgagcaaaaacgcgcgtaggctattcggacgctgtttactgccgatcacaatcgcagacagtagtggcaacatcggtaacacacaaggcgtaaaggcaagccccagccctaacacaaagaaccaaaaaatagcaaggcgattttcggctaaggtttcggcaagttggttctgttcggctttaggttgagcgatagaaatagcggtaacatctgcggtattttttgcaacattatcagcggaagtcgccgcttgtaaatcaagggttacttcttcagggggatagcaaaaacctttggtgcaaccttgataacgcaccaccacttgcccagtcgcattcgcttcaagggcaacggggattgttagctgattgcgataaatttctacttccccaaaaaactcatcttggtaacgctctgccgttggaaattgtggctcgcccagtttggcattgtttgacgaaatggcgatctcttttttataaagatagtagccatcggcaatctgccaagcgagttgcagttgatccgcttgctgttgagatgaaaacgcaaatgcctgatcgccgggtagaaatttaggttgtgagctaaataggcttgcagtagcaggcaaataaaatgtactcaaggaaaagagtgtaaaaataattttaaacatagataattttctcccttcaagataaagtgaattgtagatgattgctttatatatacaagctctttcacttaatctgagtaataaaccaaattaatctgtccacgctccccttgtatccaccaaccatgtaggagatagatgtcttttagcatgttgctgaaatgccagatgatctactaagaacacgacaacatccgctgtgataccttgagcaaaatccacccattctactttttctgcaagggaagctggcaattgagctatatgtggttcaaccagccataatttaccctgatgccaatcggcaaagtattctgtaattgctagggctgggctctctcgcagatcggatacgttagctttaaaggtaatccctaaacaagctaatgtcagatcagaaattttacgatttgttgcaacggcacattcggctaggcaactttttattttatcaataacccaaaaagctttactatcattgacttctcgtgcagtacgaatcaagcgtgcatgttctgattgagcaacaataaaccatggatcgatagcaatacaatgccctccaaccccagctccaggttgtaaaatacttacgcgagggtggcggttcgctatgcggatcaactcccaaacattgacattgagttgatcacaaatcattgatagctcattggcaaaagcaatattcacatctcgaaaactgttttcagtgagtttacacatctcagccagccgagagtcagtagtaatacattctccttttgcaaaaagctgatacaacgctaccgcttgttgtgtgcagttcggggtcaatccgccaatcacacggtcgttatgatagagctcatgccaaatattgctaggcaatactcgctcaggacaataagcgaccgccacatctgtgggaatagataaatcagggcgttctttttcaatccattgagcaagttgttcagttgttcctacgggagaggtagattctaatactactaaattcccttgtcttaagtagggtgcgatacttttcactgctgattgtattgcggttaaatctggttgacggttcgcctgtagaggggtgggaactgcaataataaatgcatcggcaaaggttggttccgtgcttgcataaaaatgccctgaacttaccgcttgtaatacagcttgagctagttcaggttcatgtagatgacttcgaccttgattgatttgttcgatcacacgagggttgcaatcaatgccaatcacttgtagccctgcaagtgtaaaagccgctgctgtaggtaaaccgatatagcccaaccctacaaccactatttgttcaaatacagccattacattgttccttgtgcaagttgttttatcaccgcgacaatacgttcactcgcattgccatcaccatacggattttgagcatggctcatttgttggtattgttgtggatcatttaataatgccttcacactttgaacaatatgctcagcattagttccaactaactttactgtgccagctaacacagcttcaggacgttcggtgatttctcgcattaacagtactggcttatgtaatgcaggtgcttcttcttgaatgccgccagaatcagttaaaattagataggcttgttgcattaaatagataaaaggcaaataaggttgaggctcaagtaaaaagagattatcaatattggctaacaaacgttgggttggctcaattacgttaggattaaggtgaacaggatagacaatctgtatgtcagtatgctgttctgctaatattcgcaaagcatggcaaatccgtttaaatccatcgccaaagttctctcggcgatgtcctgtgactaagatcagttttttatgtggatctaaaaagggaaactgctgctgcatctgttgagcgagcggtcgattttgtatgattttttgcgacatcatcattaaagcgtcaataaccgtatttcctgtcacccaaatacgatcttctgcatgatgttctgccaataaattagctttagccttatctgttggggcaaaatgatagttggctaacacgctggttaaatgacgattagcttcttcagggtaaggggaaaaacgatttcctgtacgtaatcctgcctcgatatgggcaatcggtacacgctgataatagcatgccaagctgacagcaaatgtggtagttgtatcgccgtgaactaaaacaagatctggctgagattgagacaacacctcacttactcctagtaaaatacggcttgtaatatttgccagatcttgccctgatttcatgatatttagatcaaagtcaggttgaatatcaaacaaagataaaacaggatggagtagttggcggtgttgtccagttacacaaacttgaatagcaaaagcctcttcctgttgcaatcttttaataaggggagccatttttattgcctctggtcgagtaccaaagaccgctaagatacgatatgccacaagctagtttttcttacgattaatgaacaacacaacgaaaaagcctagcagtaacccaataccgccaccaatagctgtccataacagctgatctttaggggcttcaaattgtgcctcagctttccaataagctgtttgcgttgttgcaccaaaccaacccgctacaccgccaatagcagaaagcattaataataaaaataaagatgtaaaaaatagtcctacactagaacgttgtgttttcacttgctcactcattaaattattcctctaaacagtttgttttcttcttgcacggcgtttgtggcgacgaacaaatcgagtaattcgccacacctggacaatagaataagaatatagaaagaaaaggaaaacaaaggcaacaaacattacccattggttccagtaataaacttcgccaattacgccgaaggtcgcacaaagccctgcaccaaaggtaattaccgctaacgcttggtgtgaggttaaacctgcacgcatcatcaaatggtgaatatgcaagcggtctggtctgaatggacttttaccttttttcaaacggcggaagaaaaccgcaaccatatcaattaatggcacggcaatcagccataaacctgttattgggctgatggggtgtctttgtccttgtgtgctgagtagtaaaatccagatgatggtaaaaccaattagggtactgcccgaatcgcccataaagactttccattttgccccaaaaacgctgagattaaacattgcgtaaggcagtaacaccaagataataccaaagcaccaataggctagcgtatattgctcgtcaagtaacattaatgtgcctaatccagcaaaacttaccgaagaaagtcctgcgagcaagccatcaataccatcaatcatattgaacgcattaatcatgccgatggtgataaagacggttagtacgacacctaatgccccaatttccaagctaaaaggagcgttcagttgttctaggttttcaatggataaaccgctgtaaatcattgccccagcgagtacggcttggatacttgcacgcagaaatggactaagatcaaagcgatcatctaacacgccaatcattaacaaaatggttaatgcgatcaaatacagctctggcaattgcatctgttcccattccaataagtagaaagcgagattgccaagataaagggcaataccaccaattaagggaatgacaccttgatggtgtttacggaaattgggcttatcgactaaaccaattttttccgccacaggacgcattgcaataagtgagataaaagaaaccaaaaatacagcaataaatgtcagccacatatactcggtttatcctttcaataagggaaaactaaaatgctggctagcatagcataaccgctgaaacactcaatttttttcacgcagaaagcgtaatttacagtaaaataactccattttacgtgattcacgttaaggattcttatgacaacatctcaatctctttttgaaaaagcacaacgtgttatcccaggtggggtgaactcgcctgtgcgagcttttaaaggtgtcggtggtacgcccgtgtttattgacagtgcgaaaggtgcttatattacggatagcgaaggcaagcgttatattgactacgttggctcttgggggccaatggtacttgggcataatcacccagccattattgatgccgtactcaaagccgtacccaacggattaagttttggtgcgcctactgccattgaaattgaattagccgaattagtctgcaaacttgtgccgtcaatcgaaatggtgcgtatggtcagctctggcacagaagcgacaatgtccgcgatccgccttgcccgtggctatacgaaacgtgacaaaatcattaaatttgaaggctgttaccacggtcactcagattcactattagttaaagcaggttcaggggcattaaccttaggtcagccaagctcaccaggtgtacctgaagattttgcaaaacatacactcacttgcgaatacaataatttagcatcggttaaacaagcctttgaacaatatccaaacgacattgcctgtctaatcattgagcctgtggcgggtaatatgaactgcattccgccaaaagaaggcttcttgcaaggcttgcgtgaactctgtactcaatatggtgccgtatttattattgacgaagtgatgacaggcttccgtgttgcacttggtggtgctcaaagttactacggcgtaaccccagatttaaccacgcttggtaaaatcatcggtggtggtatgccggttggggcgtttggcggtaaaaaagagattatggaatttatcgcaccaacaggccctgtttaccaagcaggtacgctttcaggtaacccgattgcaatgtccgctggtttggcttgcttaacggagctatcaaaagcaggtaatgagcaactgcttgcagagaaaaccaaaacccttgcggaaggtttcaaagcattagcggataaacacggtattccgatgacagttcagtatgttggcggtatgtttggtctattctttaccgaacaaaccaaaatcgaaagctatcaagatgtgatgaaatgtgatgtgaaagcgtttaataccttcttccataaaatgttagaaaaaggtgtctatcttgcaccatcagcctttgaagcaggttttatgtctttagcacatagcgacgaagatattgcttatacgcttgaaatggcggatttggcgttggctgagatgaagtaatattataagtggtatttagaaatatctatttgttttataccacttggtaattaaataagcggtattctctcatgaagattttgcaaataaatagataatcagcttgtagggtgggtcttgacccaccatataaccgtaacatattgattttattggtaggttaaaacccaccctacaatattcaatctgtttaatatatagtttgtcagcggtctgagatgtaatgcccccatattggaggcattacatattaacttagttattgcattttgtttacagatggtatcacaatccaaaatatcatacctattgcaattccagcagctatagctaagctagatgaaaataacccaacaagccaataagtgatacctccgaataatatgccagcaaaaataccgaatctccccagaacctaccactcttttactcttcccctttcaacaagcggtcaaaatcgctttcaaaatgttgatcttgaataacacgatatttttcaaactcgctcaaggcgtgggctttggcgatttcgacggtaactttgcctgcgtcttgcaatatggctcggtcagtggcgtctaaaaagcggttgagtctggtttcccaatcttgcattgtcatcggaatttggcgtaacgccatatcttctgccatatccaaataagcggataccaagcgttgtagttgagccagctcattgtcagataaataatttttcgccaccacatcaaaaggataaattttgccctgcggtgcgtctttccaagtggtcaagcccatattcggcttgctggcgtttgctcgttccacaatcaattctgcggcggtatgaccgtgaattgcccaatgcaacttattttgcaccgtggcaaaaaagcgtttggtcgctgtggcggtgcggtcgtaatcaatagaagtcgcataaatatcagtgattttttggtaaaacttgcgttccgacaggcgaatttctcggatacgggcaagttgttcttcaaaatactttttgcctaaacgtgtgccgtcatttttcaaccgctcatcgtccatcgcaaagcctttgatggtgtaagtttgaataatctcggtcgcccatttgcgaaattgcaccgctcgctcggaattgactttatagcccacggcaataatcgccgaaagattatagtgtttggtctggtaatttttaccgtcatcggcagttattcgaaaatttctaataactgaattttcgtctaactcattatcatcaaatactttttttagatgataattaatcgtaggcacttcaacatcataaagctgccccatcattttttggctcagccaaacattttcgtccgcataaatggcattgacttggctctcgcctgtagcggtcataaaggtgagatattccgccactgaagaaacaatttctgatttggtcatacaagctccttactgaaatcttgtttagtctaatgacatttgcaacactggcaaagggggaaaagcattttttcgatgcagatcgcaaaaatttgtgaaaatccgaccgcacttcccccactacttcaccatcggctcaacccgatccccttcgttaatcaacgccccagccttttgtaccacttgctcgcccactttcaagccagataggatttcggctgtgccttgattgacttcgcctaggctaatcgggcggcgttctatttgttgattgcgattgaccaccatcacaaaggcggttccgtcagcgttaaaattgaccgcacttaacggcaaggtggtttgggcttgcatttcgggcagtttgattaagactaaagccggtgtgccgagcgtgatttgggctggggtttgcagctgaatacgcactttgccggtacgacttgtttgggcaatttgggaagaaagcaagcgaatttgaccgcttgtcgtttggtcaagcacttgaatttccgcctgcaagcccgttttgagcaaagataggtcttccgcactgacatcaacggtaacttccaactcaccattgcgtgcaagatgaaacaaggcgttgctgtccgttaaattgcccacttccgcacggcgttgcgtgataatgccgtctgcgggggcaagcacctcggcttttttgcgttgataacggctgtcgtcaagctgtgcctgtacctgagcgatttccgcattcgccgcccgaaccgccgcgcgagcggcacgggctttcgcctgttgttgctccaactcctgacggcttatggcatcgcttttaatcaaggtttgataacgtttcagcgtagtttccgcctcagttaaagcggattgctgcgaaaccaaattcgccttagctcgctgtaaattcgcatcattctgacgcaactgcgattgcacattacttgtttccagcgtggctaaaacctgcccttttttaaccacatcgcccacttccacattgaccgattgaatttgcaaaccaagcaatgccgttccaacagcaacatcttctttcgccgtaatcgcccccgaaagacgcaacgtctgcgttaatgtggcaggttgcacctgaaccatatttactttcattaacgctgctttggtttgctcgttggcttgctcattgttttgctcttggcaagcggttagaaataagatgggtaagacagataataaaatcaattttttcattttaaagtctcaaaaattactagtttgcggcattattcgttatttttaagactaaatcaagtaaattttaggactgttttgttatgttctcaaaaattccaccaatgccctaaacagcggtgaattttatcggtggttggggtaataaagatggtaaattttcagtaaccaaattttaatccaaatttcccaaaaagacagtaaatcggtagctcaagtggtcttatgttggcttaatcaaagtagcgtggcgattattcccaaatcagtcaaagtagaacgtatgatcaaaaactgtgagatttttgatttcactcttgatgagcaagatttagcccaaattaccacactcaaccgtgatgaaatcatcttcaatcaccgtgatccgaatatggtgaaatggttggcggagtatcgtgggtaatatttgaagtgaggtcgatttttacaaagttttgggagaatttgactgcttgtgaaggatgccgtctgaaacttcagacggcatttttatatcaacccagatctaaagctaacatgaattttcttttcaaatcatttaatttatctgcatttatttcgttattctctaatttcttaagtatttcaagtggttttaagtcagctcttgatggtaaatttaatcctaaataggactcgatacattgtggtatgaaaactggctctgcaattttacaattacaatcatagtttttaagcatatcatttatagcctgatgatggtttttatttaaatcatcatcaagtatcaatccatatgggatgccaaaaatatcaagaagagtcatataacgatgaaaattaaatttaccaataacatcaacaacagctatacgatgttttgtaaatgtatgccaatcatggttgtttgccaataaccaattaaataacgccttttcggtcggaccttctaccaataatactttatctgcaaagaacattgatgagcgttctgaatccagccaaagttgataacgaaatttttcattttggatttctatttcattattttgttcagagttctttaatagttcttttgctgtcttcttcctatcatcgggaatatttgcattattcacaaaattttgtaagcaaattttaaaatccaagccacttgaaaaaatattgcccaattcttccaattttatttgccctaaagatgttaatccatcttttttgtgaactcgtcctatctggcacaaactgtctgttgcttttcctacaaaaataggtgaatggctagtgatgatgacttgttgctcgttgccttctcctaatcttctcaaatgatatgccatattttcttgttgtgttgggtgtaaaaatgcttcaggttcttcaaatagaattaatgtaaaatcagggttaaaatcattcttctcctgagtagtattgttttcattggatatttcaggcactaatttaattaattcatataaaaaagaacgctggaatccatgtccatatctatcaagagataaagcataatcacctaacatagaatcaacaaatgaatgtctaatgagattttttgtaatatcttctggagagatagcaccaatagacatatcaaacttaatcccccagcttgaaatagcactatttataggatttgctatttgatccaaaaaaccatttttatttttagcttcatcattaaactcatcaaatgaagttattactttttgataagcgggactattaaccaaagctttttttaacatcaaattcagcatatctctcaatggagatgctccagatgttttcatttgttcgctagctgatataaaagcaggaatataaatgatttgtcctaattttgcagagccaatatttttagctccataaaatagtgattcgtcaattacaccatcaacaatcccatatatattactctgtcttggttttactttctctttagaaataaaatacttacgaacagttaaatgcttttctttagttcctttatatttatctgctaatgcattccattcgttatctgttaattcaaatttaagttcaacccaactttcgacttctatctcattttctaatacactactgttaaatttaggctcatcatctttagtccatgcgacatcttcataaaaagctcgtaatgcagccataatattgcttttacctgcattatttgcaccaactaacatcgtatagttatgaacttctatttcaacatcatgaatagaacggaaatttttaatatggatttttcgtaacttcataagtttttctcctaaaacatcatatatgcctgttctatattacatcagcaatacatagccaatcgccgtctaccctaaaagtatcttcaaaaactccctcaaaatcaagagctatcccccttcaaaagtattgttctcaaattcatctatcgtcaccacatatttcgggtagttgtcttgaattttgaacaattttccacgattttgcacacgatagccaatcaaggcgtttcgcaaacctaaatcttcaaaataggaaaaaattttatatcaattcctttatacaacacccatacaacggcacattcaccatccaatcctgttccctaaaatccgccattgaaaaacgaaaagcctgttcgggttggaattgttctacgtacactttcaaacttttggctttcaaattttcttcggctttgacttcaatcgggattacggtttgtttgcgttgtagtacaaaatctacttctgccgtgcctttttctgttgcccaataaaaaacgggattttcttgggttgcaagcaattgttgtaacacatattgctcggttaaagcccctttaaatttaggcagcaaaaacatttttatcaacgaaaatcttgctaaaaacacactttttccaatgaaaaagtgaatataaataacattttttcaattgataaaaagatattccgccttttaaaaagcaaattttaataccaatatctcttgccttttctctttctcacatctaaaatagcactcaatttagtaatttttaggactttaaacaatgagcaacttcgataaactaggcaaacaaatcagtgaagtagatgccacaatggacgcttggatctccaaattaggcttgggttataaccattttgcggtgctgtattcgttggcggcagcggaaagggggcagtgtacgcaaaagcagatttgcgatgaatggctgttgccgaaacagacggtgtttaatgtttgcaaggaatataaggaaaaaggctggattgagtttagcgaaagtgcggtggataaacgggaaaaaataatgcatttgaccgcagacggcaaggcgaaggcggaaccggtttggcaggcgacacagcagttggcggataaaacttttgcaaaattaggcgagaaaaagaccgctcaactatttgcgttgttggcggaattttgcacggtttgccgtgagcaaatcgacaaaacggatacggtggcttgatgtccttagcaaatcttgaaccgacctttgagccacccctcgaaccaacaatgttccgttcgctcaaaacccttgctttgcaacataaaaaacggctgttcgccacattcggcttggtggcagcggaaaatctgctgttgttgatttatcctttggtgggcagttttgcggtaaatgcggtgctaaatgggcagctggtttctgcgctcgcttacgccttgattgtgctgattatttgggggaaagcttggagtaacaaatttcccccagcaaatcaatttatcccatcgggcaaatcgtgtatgatccgcctgtttttaaccctattttgagataataagatgaaatgtgaatgtcaaaaagtgacacatcaacagcctgagttgtgtgtggctttaactcaatatcgcttgattgaagtagctgggattgatgcggaaaaatatctgcaaggacagcttacttgtgatgtagcgaaacttgctgttggtgagcagagcttaacttgccattgtgatccgaaaggaaaaatgagtgcgttgttccgtttatatcgtgcaacggcggagcagtttttcctgattattcaacaaaatctgttgcctgaagcactggtgcagttaaagaaatatgcggtgttttccaaagtgacctttactgaattagatcaggctctgtttggaacgacaagcggtgagatcattgcaaaatttaacgaaaatgtgaccgcttgttaccttgatgaagagcctaaacggacgatcttttggggcgatattgcggtagaagccaatggcgatggcagtttgtgggatctgattgatattcaacagggcgtgccgttactctacaaggctaatcagtttgagctaattccacaggcaaccaatctgcaacagcttgataaagcgatttcctttactaaggggtgttatatcggtcaggaaaccgtggctcgtgcgaaatatcgtggtgcaaataaacgggcgatgtttacctttgtgggtaatgtggaaggtgagatcgaactgccagcgatcgcctctagcattgaaatgcagttgggcgagaactggaaaagcacggggacaattttggcggtacagcgttatcaacaacagctttggttgcaagtggtgctaaataaagaacttgagccagaagccaatttccgtgtcggcaatgtcagcttggcattatttgaattgccttatagtttggaagaaaactgatgtttgaatatccaaaagcaaagttcattgcaggggtagatgaagtcgggcgtgggcctttggttggggcggtggtaacggctgccgttattcttgatcctaatcagccgattgaagggcttgccgactcgaagaaactctcggaaaaacgccgtcttgcgttggcggaagaaattaaagcgaaggcattgtgttggtctttagggcgagcagagcctgatgaaatcgaccaactgaatattttgcacgccacaatgttggcaatgcaacgagcggttgcagggcttcgtattcagcctgattttgtgttagtggacggaaatcgtattccaaccttgcctatgccagcacaagcggtcgtgaaaggtgatagtcttgttgctgaaatcagtgctgcatctattttagccaaagtggcacgggatcaggaaatggacgaactcgataaacagtatcctgagtacggctttgcacagcataaaggctacccaaccaagctacattttgaaaaattagaaagcttgggcgtaaccccttatcaccgtaagagttttgcccctgttgcacaacgattaaccaaagaatgaaaaaagacgagatttacttacagcgatgccttgaatgtgatagcgttgtcagcatagcaaaagatctgcctaatcagaccgcttgttgcccgaattgcaatgaagtattgcaatctggtaaccgttggagcttgcgacgttgtgccattatcgccttatctattcttattttattgccttttggcttatggttgccgttgatgaatatcgacctactaggcgtgccgatttatgcgtccgtttggggtggcgtatggaaaatggcgacggaaggcttcccctacacggcatttatgattttgctctgttcggtgataatgccttttgcctttgctggcttggtattgttgatctttattcaacggctaatccaccatagaccacgctacaccttgattttactcagcaaagcgaaacagtgggtgatgttagatgtttatctcgtggcgattgccgtggcggcatttaaagtgcgtgaatatgccaaactggagtttgactactacattatcgcattcataatgacagcgattttaaccacgttactgtttatcaaaatagatccaaaacgttggtgggaactgttttatcctgaatatcatacgctgcctgctgatcacccttgccaaccaagtatttgctcggcttgcgaatatacctttgatgaaaatatcgtggataaaaaagggcgacatcgttgtccacgttgtgaaagcaatttagatgtatccgacagcattaaactacaacgagtatgggcgactttgattgctggggcagtgatgatgatccctgccaaccttttgccgatttcatcgaccgaatttgctggggcaacttccgcagatacactgatgggcggggtgattttatttatggaaatgggcagttacttaattgcagccattatctttattgctagtattgccgtgccgtttagtaaagttgccgtgattttctacttgttgcttgcgatccattaccgctggaaacacccaattcactggcagatgaaactactacactatgttcactttgtcggacgctggtcaatgttagacttgtttgtccttgcattgatgatgtctttggttgaacgagggcaaattatcagcttctcggtgggcgaagccgctttctattttggggcagccgtttttctaacaatgatttcatcatcaaacattgatgccagaatgttatggcggatacatcgagagcataatacaacccagtcaagcggttagatttgaacaaaattttgcaaaggtttatacttccaccaataaaattgaaaaaaggagcaagttatgcgtgttgatacttctgaactttgtgatatttattccgatcaagtagatgtcgtcgaacctattttttctagctttggcggactttcatctttctacggcaaaatcaccacagtaaaatgctttgaaagcaatggcttaattgcagaagtgttggaagaagaaggtcaaggacgagtgcttttagtcgatggtggtggtgtagtgcgtcgagcattaattgatgcagaactcgcccaacttgccgtggataatggctgggaaggtattattgtcaatggtgcagtacgtcaattagatgtattagaaaccttagatattggtattcaagccctcgccccaattcctgttggagctgatgactcaatggtgggtgaagttgatacccctgttaattttggcggagtgacctttttgcctgaagattatgtctatgcggatttaacagggatcgtgttgtcgccagaattgctggatttacaatcagaggatatagaataattcttgtattttcctttgcatgtatcggaatgggagtaatataaaatagccactaaaaagtggcttaaagtctcttatagcggcattatgtagcagttgaataaaaaaacaaaatgcaatattaaccgcagtaaattttcaatgatcttaatcgctaaggacctttattttagtgaattttagccgtttttccccacttttcattcattataaaaaatacctgtgtctgaatgtactattttagaaacaggtatttacacaaattgtgggagaggctcttagagacatagtttgcagaaaaaccaacacttttgtctactatgccaaacaatgccattgttaaaataacaatggcattgagcatgaaattctaatttataggcgctagattaccacacaaaacctacccctcctccaatcgcagtatcccgctgagtattactgccaacagacgctcgaataagccatttgccattatcagaaattctggaataacctatagcataggcagattgcccgcgatattgtgcattagaaacagaaatagcacttttacctggtaaaaaaatttgtggcaaattagccatcgctacagcagaagcaatacccgctcttgcattaacatcaacacgaccaatatctcttgataattgattaaatcctgtattcacagaagaaaccactttgttgagctgacgaacattcacaatatcgccctcagcactaccatctccaacgttggtaattctggcgccattcatatttacaactggatttccttgcatatctttacctaaagatactttggtatcgccattactaattgaagtaatgctgcttaaatctccagacacgctcacattgtaaatattctgaccatttgcacccgtttttgaagtcactttcacatttttacccgcttcaacttcagttcttgccgctgctgttgcggtattaattgctgctgcgacttcatctcctgtcgcaaaatggttgcctttatctgctgcactaatggtgcgtttatccttagaggcagtgagtttcgttttagcaaccgccaaatcatacacgatttgctgattatcgccctgacgctcttttatcaccacactgtgatcggtagattccacttcagttttcgcagatttcaactgtttcacattaacagcgtccgtatctgctaccccttcagcaacattacctaataccatcggagtttcatttgccaaattcacttttactgctaatgacttaagcgtaatactgccatctggattttgcgttttggttgagaatttacctttaacattcaccactggaattaacttaatcgaaccatctttagcaggttcttccaaatagaaattaccgcccatattgataattgatttgccgtcttccgttgcatactcgatcggtaaaccgctgacactcacatttcctcgctcacccttaggtccctgagcacccgctgttccctgcggtccttgtggtcccgttggacccgtaggtccttgaataccttgctcacctctaggaccctgttcacccctaggccctgctggacccactggacctgtatcaccttttggacctgtatcaccttttggacctgtatctcctttaggccccgcttgtcctggatcgcctttatcccccttaggaccagttgcacccgcaggaccagcttcgcctctaggacctactggaccttgagcaccggttggaccagcaggccccattggacctgtatctcctttttgaccctgttcacccttagcccctgctgggcccgcaggtccagctgcacctgcagggccagtttcaccacgatctcctttttcacctttcttgatagtgctatgcgaaccatctgtataggtaatttttacatcgccatttgtttcatttaccacattttcaattaacttacccttagtggcaatggtgatattaccgttctcttgagttagtttaatattatcgcctgcagtaaattttaccgtatcgcccattttgataagatgtgccgcaggtggatttgcttgaccagcccctttcgcaatcatcagtttccaacctgcattattcactgccgatactacatcattaacggttgctagcccatcggtttgttttgataatctgccatcagttgttgtagtattaaagctacctgaagtgacggcaaaagttagatttttattattgtgggtaatctttatattgtccccagcagtaaactggatcgtatctccatccttaattatagcttcattgttatccttatttgttttaatcttaaaggatgacattttagtggcaatctcagccagttgtttcttaatcttgtcctctaacgaaatcgtgattgttgaaccatccgctttggtcttgatttcatcactagtgcctttaacttcaagtttgccattccaaatacccactttctcatcatcagaattgcctgtatcccctgcaatcttcatcgttaaagatttaagctgtgccacgtttaccgcatcggtatcttgtgtaccagccgccacattgacgatttggcgtttgattttgtcattacccacagaaaccgcaccaataggattgttatcaacacttcctgtagatttaaagccgttatcaacactgcttgctgctgttacagaataagactgttttgccccttcaatatcacctgctctatctgccttagagccataacccaatgccacaccgccacccacggtgacaacggtattatgaccaagtgcggttgctctagcagcaccatcatttgtcgtggcactttcaccaaccgcaaccgacctttcacctaatgcttttgcgttataaccataggcagcggagtgtgaacctgccttagagttcgctccaatggctactaatttttcacctgtcacattgatattggcacccacaacaacagagtctgcccctgttgttttcgcagaattacctatcgcaatggaatcttccccagcacctttcgagtccctaccaacagcaacggcgttttttccagcagttgcaccaccaccaaccgcaataccgtactcagcggtagacttacttctcgcaccgatagcaatgccttcaacacgacttgcagatgctacaggacctaaaacaatagatccttcgcccgtagccacagaaccacccccaatagcaacagaggctttacctttcgcagttgttgttctggaatggttttgaacttcagtttgatatctcgttgtatttaaatcatctccaccgattgatatggagccatacccctccgctttggtatttgccccgatagtaacagattgtgacccagttgcactagcaaagttacctattgcaactgcttgagcacctgccgcactggcttctgagcctaagatagcagtgctcccttccgcttctgaactactcgcgatagcaataacaccaaccttactccaaataactctaaatattttattcataataatcttctctaccgcttttcctaataaaacatcgtaaacctttatttacattttcaggatgtacaaatgccccccatcgccctcgctttcgctcgggcacttcccccgcaagcgggggaagttaactccttgacaaaccatatattagatggattgaatattgtagggtgggttttaacccaccaataaaatcaatatgttacggctacatggtgggtcaagacccaccctacaagctgtttttcctaataaaacatcgtaaacctttatttacattttcaggatgtacaaatgtccccgcacgctattgtaaaaaaaaaaaaaaaacaagagttacacaaaactaagaataaaataacaagaatttttcaacttttatcaataaaagttagaaataataggcggaaatctaatgaaagcggtgatttagataggatattttgcatagtagacaaaagtgttggtaataattaggaaaaataattaaaaccaacacttttgtccattagaggcatagtttgcagaaaaaccaacacttttgtctactatgcctcaaattatcataattactgtcttggcaagtagcgagcaggatctaccgacttaccttgatagcggatctcgaaatgcagtttgttgctgtttgtccctgtgctacctaaagtcgcaatggtttcgccagctttaacattatcttgttcttccactttgatactgtcgttgtgagcataggcactcaagaagtcatcattatgtttgatgataattaagttgccgtaaccttgtagtgcgttacctgcataaactactcgacctgccgcagccgcttttactggttgccctttcgttcctgcaatatctaaacctttattgcccccttcagatgcagagaaaccagaaattacacgcccttgcgtcggccactgccagcgaattgacgatgccactgctggtacagatgttgagctgtagttcggggtattgttagccgcagttgcggttactcttggggttgtagaagtttgagcaggtggaacagtgcctacactcgctttcacaggaccagtcattgtaccatctgagccataagcagtgccgttcggtgcttgggtataagttactacaggttctggtgactgaacagtttgttgttttggttcaataggttgagtattacccaattttaaaacctgccctacaccaagttgataaggctcgctcatattgttcaaagcagcgacttccttaacatctttacctgcaatgtatgcgatgaggaacatcgtatcgcctttgcggacagtgtagctgtcgccattatagaagcctttatcaatttgactataaataggtgcattgttggcatcacgaggaatagtaaaatcttgtgatacaggctttttcgctacgagtgttgttttagctgtcggctttgttatcggctgaggaacaacttgaggcacgggttgaggtgcttgataagttggctgcggagcttgatacacaggctgaggcactggcggtggtgtataagttggttgtgtcatcgtgcttggcatagaagtgctttgcacatctgtctgccagccgtaattagtattgtttgcccccataccaataggttgcattacgccaggtgataaatcagaaccttccgcatttaccacaggtgcaggcgtatttgaaccgcaggcagtcaaaactaatgctgcaagcggtaataagaaaaacgattttttcattcaattatccttcaaagaaaacgaaaacgccaaagggcgtttaaaaaagtctaaaacgctacagcgtctgctcaatatggtaatggacgcaacccctgcgtccattcaaatgtcattacaaataaaactattttactctaagtacttgacctactttcaatggcattgctgtactcaaattatttaaagcagcaatttggttaggtgtttgccctgtcaaataagctactaaaaagagcgtatcgtgtttgccaacggtataagtgctgtctgtatagcaacctttctggatttgactataaatcggagcattacttccatctcttaccacattacaacttccgaccacttcactttgatcgccgtagttcgtttgaacattgcttggttggctataagtcggttgtggtgcaggctgataggtcggctgcggtgctggtggcggagtataagttggttgaggctgataagttggctgtgtcattgagcttggcatacccacttgttgaacttcggtttgccacgcagatccaacctctgtcacttcaacattaggcgaggtttctgacgatgtatctgatgaacacgcagctaacactactgctgcaagcggaagtaaaagaaacgattttttcataatagcctcttattttaataaggtataaataacataggcagcaacggcaatagacactgttccccaaccaattaattctattgaacgacggatcttatcggcgtatttctcaccgccccacgcagataattttgccacaagtagaaaacgaataaaacgagaaattgaagcggtcaaaataaagggtaaaaaagacatctgcaatacacctgcacaaagggtaaataccttaaatggcacaggtgaaaaaccagccgcgaggaaaataatcataattccccaaatttcaaaccagctcattgcacgatcaaaatttgcctgcattccccagttagcaaccacttcttgtacccaatctgacgcaaaatagccaacacaataaccaataattcccccaataatagaagaaacggtagcgtaaatcgcataacgtgtcgccatctttggtttactcatcgacataggaataagtattacatcaggcggaatagggaagaaaatcgcttcaataaaactcacaaagctcaaccaacctgcagcaaagcgatgttttgaccattccatcgttttatcataaattgttccaaaaagtttcatttaaaaagcctcatttaaacgtgaaatcgacaaatgtgcagtcatatctggttgaataggggtgatagacacaaagttatggttgattgcataaaaatcggtaccctcgctttcatcggttggcttgccactagccccaatccaatacacatttgccccacgcggatcttgttgcttaataatctcagccgcaggagaacgatcgcctaaccgagtaatttgaataccttgcaactcgtgataaggaacatttggcacattcacattcaacacttgatttgcaggaataagatttgccgtgattttcggcaatagttcaaccaccacttgtgcagccgtatcgaaatggcatttgcctgttaaataggttgaaccgtgagaacccactaaagacaccgccactgatggcaacggtaagtgacgaccttcaagagccgcagcaacggttcccgaatagaccacatcatcacctaaatttgccccgtgattaatccctgataccaccaagtcaaacggatcatcaagtaaaccatttaacgcaagatgaacacaatcggcaggcgtacctgcaatcaccgtataatcaccattctcaaatttatgcacacgaagcggatcaaccagtgttaaacagcttgatgccgcactgcgattgcgatcaggggcaacaatggttactttatgtcctgcttctcttaatgctttcgctaaaaattgaataccgtgggcgtgaaagccatcgtcattgcttaatagtatattcattgtgatttatttccttatagttgtaattcccccctttgaaaaaggggggctaggggggattttaaatagtacggtaaaatatctggatctttaaatcccccctttttcaaagggggaaagtttagttattcttcgagctgtactaattctctcaccaacgccgtagcataactgccagcatctaaaaagaatttcaaccgtaaaccttcctcttcaaatagccattcaaagtgttgtggtttacagaacatcgcacggcgagctgagttcattcgttcttttgccattaatgccagtagatcttgatgttccactacgattttttgctcatactcagacaccgtttgtgtggcagagttttcgccgacaagcggtgcagtaagtaaaatatcttgcaattccaaccgcttgttaagtgccgcaagttcttccgctttcgctacaaaccagctgtttgaacctgccagttgcattaaatcattttccaacacttgctgggttaaaccgagttcaatacggttcgacaccacaagattgaaaatttcactacgagcggcagaaagataaaaactgcgttttttgcgatctttaactgaaatttcgcctttcgcccaacgctgtgcttgagttaaattgtgcccatctcgaccaaaacgctgttcggtaaaataattcggaaacccgaccgcttgtatttgttgcaaacgagcggtgagaacattgctctcttttacatctcttagcaatagctcaaaatgattgccagccaaacttcctacccgaattttgcggttatggcgagtgacttcaatgatttctacgccatcgagttgaaactgtgtgaaatcaggcgtttctttgcctgctaaatgtaaacagaaccattgttctgtgactgcgtggcgatcttttaacccagcataactcatatttttggcagaaataccaacaaattctgccaacttttcgcccacaaacaaggtatttgcatcggttttacgaatttttaccgccacaaattccccatcgcctgacaaatcatagccaagttcttctttgacaataaaatcggcaaattctactttcaatcgacccgcttgggtcggtttgccgaataaatacgctaattgcattgtttttcctattaaaaaaggcacgagaaagtgccttatcgttacttaatggctattttaacagttatttttaaatattgagctgaaatcttgcggaaaaacaataaattttctgtgaaatttggtatagttcgcacgtttttattttacatttcactcaataggagaaacaaaatggcacgtcgtccgttagtaatgggtaactggaaattaaacggtagcaaagcattcactaaagaattagtggaaagtttaaaaagagaacttgatggtgttacaggttgtgatgtcgcaatcgcaccgccagtaatgtatttggcagaagcagaagcggcattagcgagctgtggttgtgaatgtactacgaagaaactcattgcattaggcgctcaaaacgttgatgtgaatgtacaaggtgcatttacaggtgatatttcaactgcaatgttaaaagatttcggtgcgaaatatatcattatcggtcactctgagcgtcgtacttaccacaaagagagcgatgaatttattgcgaaaaaatttgcagcattaaaagaagcaggtttagtgccagtgttatgtatcggtgaaactgaagcagaaaatgaagctggtcaaaccgaagcagtatgtgcccgtcaattagatgcagtattaaatactttaggtgcagaagcattcaatggtgcagtaattgcgtacgaaccagtttgggcaatcggtacaggtaaatctgcaaccccagcacaggcgcaagcagttcacgctttcattcgtggtcacattgcaaaacagtcacaagccgtggcagatcaagtgatcattcaatacggcggttcagtcaatgatgcgaatgcagcagaattatttactcagccagacattgatggtgcgttagtgggcggtgcgtcacttaaagcgcctgcatttgcggtgatcgtaaaagcagcagaaaaagcgaaagcgtaatttttttcgcttaaagacaagcggttagatttggtaaaatttttacagaatctcaccgcttgttgatattatttgcttgtaaactatgcaaataagttaaaaatataaaaaaagggttgatctccaacgtaaaatccgtatgatacgccctcgttacgcaacgttaagggtcgttagctcagtcggtagagcagcggacttttaatccgttggtcgaaggttcgaatccttcacgacccaccacttaatcagcgttcttttctaaagggtcgttagctcagtcggtagagcagcggacttttaatccgttggtcgaaggttcgaatccttcacgacccaccactttagaattcaactctcaaacgggtcgttagctcagtcggtagagcagcggacttttaatccgttggtcgaaggttcgaatccttcacgacccaccacttttattttgcatcaaatcgaaaaaatctttccgcttgtcgtggcttttttggttgccttatagtaaggtttactctgtttttcttttgattaaaacttcatagcaatgttaaaaaaaattcttatttctcttgggcttttatctgttattgcccttggcggtggcatttatgtttaccagaaactcaatctgttagctgaacataaattaaccgttaaacctgagcaactgtttgtgttggaaaaaggtacatcaagccaaaaactcgctcagctattagcagagcaaggcattattcatcgtgatgatgtggagctattaccctatttgatccgccttaaccctaaactcagtaaatttaaggctggggtttatgcgttagataatatcgctacggtgaaagagctgttgcaacatttcaatagcggtaaagaagtgcagttaaatgtgcaatttattgaaggaaaaacctttaaaacgtggcgtgagcagttggcaaaggctcgctatttagaacaaactttgacggataaaacagaggctgacattgctaaactattgggaatcactcaggataaattggaaggttggcttgcccctgatacttatagctatgtgccttattccaaagatattgatgtgcttaaacgtgcctatcaaaaacagcaaaaggcgttggaacaggcttggcaaaatagggcagaaaacctaccgcttaaaacgccttatgaaatgctgattttggcttcaattgtcgaaaaagaaacaggtgtggcaaatgagcgtccgcaagtggcatcggtatttatcaaccgcttgaaaaatggctggaaattgcagaccgatccaacggtcatttacggtatgggcgataaatatgatggcaatatccgtaagaaagatctgcttgaacctacgccttataatacttatgtgattgatggtttaccgccgacaccgattgcaatgccgagcgaagcgtcaattaaggcgacggcacagcctgacagtacgccttatttctattttgtggcggacggttcgggcggacataaatttagtcgtaccttagatgagcataataaagcggtacgagaatggatccaaattgagcgaaataaaaagagtgagaacaaataatgcgtggaaaatttattgttattgaaggattagaaggggctggcaaaagcaatgcacaacgtgttgtgagcgaaaccttagcggctcacggtattgaatttattaccactcgtgaaccaggcggaactccaattgccgaagcacttcgcaatctatggaaagaaggagaagacggcgagcatacaaccgacaaagcggaagtattgatgatttatgcggctcgtacacagttagtcgaaacggtgattgagcccgctttagcttcaggcaaatgggttgttggcgatcgccacaatatgtcaagccaagcctatcaaggcggtggacggggattgtcggaattagtggataaggtaggttcggtgattttaggtgattttgagcctgattttacgatctaccttgatattgagccatcgatgggtttagagcgagcaagagggcgtggaacgttagatcgtattgagcaactcgatatcgacttttttcaccgtacccgtgagcgttatgtatccttagtcaaagataatccgaaagcggtgctcattaacgctgaacctgcgatagaacaggtgtcggcggatattcaacaagcggtggaaatatttttaacatcagagaaataatctgaagattgttttgaatgtgtaaatataatatatttacgaaaggagcatatacatcttttcagattattgacaaaatgatttggtaagtttttatcttcttctcttcggttttacgtctgccaaatctcccctaacccctctttgctaaagagggggatcagatcgaaggatattctagttgatctacaaaatccaaaatcattttgaagaacttcgatctgaaatttttatctgagtaaattcccctctttagcaaagaggggttaggggagatttggcagaagcaaaggcaaagtgagggagtaatgaaacgaatgaaaaataagagcatatttagttttattagctggtaatttgttgaatgaatatgaacctttacccttggcataaacaaacccaccaccaaatcacttcgacttttcaacaaggtcgggggcatcacgctttattgtttaaaacagacagcggtttaggcacagagcaacttattcgccatttttcccattggttgctttgccatacgccacaacagagccaaccttgcggacaatgcaaaagctgtttgttatggcagagcggcaatcaccctgattttcacctgttagccccgattgatgataaagatattgggatcgatcaagtgcgagaaatcactgccaaattacaacagtttgctcaacaaggcggaaatgccgtagtttatctggctggtgcggaacgtttaacggaagcagcggcgaatgcgttactgaaaacccttgaagagccgaaccaaaatgtctatttcttattggaagcccctttgcaagccacaatgcttgccaccatacaaagccgttgccagacgtggttggttcatacgcctgagtcgtcacaaacatttgaatggttacagacggaatgcccgacagcacagtcaagtgagattgaaaccgcacttcgtttatgccacaaccgcccattgctttgcaaaacgttccttgaaactgaccgcttaccaagccgtaaaacctttttgcagaccttttggcgtttttacaaaagccgagatgttttcttgctcttttctgcttttgacaaagaacctgaacaagtgcaacaacagcttgaatggctgggttcgtttttcagcgatgccctgaaagccaaaatgcaaatcgcaacaggttggctcaatcctgatctgcaaaacggtattctgccttttagccaacagctgactgctcaaggtttactgaaagggcatcaaattattcaacaaacccaacgggatttacgcgaagtcaatgcggtcaatcaagagttgatgttgttggactgtttgagtaagttggtgttagaggtttttgagaactaactttccccttgtaacctctgtaacaaacgatccattgcccgatagcccaaagcttcagccagatggggctgttggatttgggcttctccagccaagtcagcaatggtgcgagaaactttgagaatacggtgataagctcgcactgacaaacctaatttcgttaaggcattttctaaaaataacgcatctcgatcagtcagtttgcaatcttgttcaatctctttggtcgtcagttgagcattgattttcccccgacggttaaattgcaaatgtcttgcttcaagtacccgcttgcgagcctgttcggtagtttcgccacgttgatcggtgttattttgcaatgcaccttgtggcagtaacggcacttcaatcgagagatcgaagcggtcgagaaaaggccctgataaacggttgagataacgcattaactgttgtggtgacgttcgattgtgcgttccttgataatgccctgtcgggcttgggttcattgcggcaatcagttgaaaacaagcaggaaactgcaccttggcattggctctggaaataatgatttctcccgactccaacggctggcgtaatgcatctaacactttccgttcaaattcaggcaattcgtctaaaaacagcacgccgttgtgtgccagtgaaatttcccctggtttcgggatcgaaccgcccccaaccaacgcaaccattgatgcactgtgatgtggggaacgaaacgggcgttttttccagttctgaaagttgagttcattttgtacaagactggtgacagatgctgtttcaattgcttcatcatcttccatttcaggcagcagatcggcaaggcgactagcaagcattgttttgcctgtaccaggtggacctaaaaacaacagattatgctgaccgctagcggcaataatcaatgctcgtttggcgtgttgttgcccgataatatcggttaaatcacggctgacaagcggtctgttttcggcaatattttgcgaaagctgctgagcaatcggcagttgatctcgattgttgagaaaattgacaacctgtaacaaggttgaagcacaataggtttgggtatttgaaaccaaggaaacttcattggcgttttgttgtggcacaataatttcccgtttcgctttacttgctgccaacaccgcaggaattgcaccgtgaaccccacgcaaatgtcctgtcaaagacagctctccaagcagttcaatccgtttgagtttatcgctgtcaatttgccctgatgctgccaaaatcccgatggcaatgggtaaatcaaaacgtccgccttctttggggagatcggcaggggcaaggttgatagtaatacgtctggcagggtaatcaaaattggcattcatcaaagcacttcgcaccctatcttgtgcttctttgacgcttttttcgggcaatccaactagggtaagtccagggcttccgccactgatatgcacttcaatggttactaatggggcttcaacgccgatagatgctcggctgtaaataatcgctaaagacatactttttcctcttttttatattagcgtaaaaagtatgtgtatctttgaatagcaaaaaatgttggtttttcgacgagtgtcacaaaaatagttaaagtcgttgtgctaaatgttgctcaatagcttcaatgatcaagtgattaattgaaattccacgtgctttagcctgttgagtaacaagttctgatagggcttcatcatagcgtaatgtaaaggttttttgcttttcttgctcaaatgcaacaataccgttttcacggcagtctgctagatattcatctagagagatttttccttcttgatataaaccaactacgctatcggcaatgaaatcacaatatcccgtcgtattgagaaatttcccacgaaacatcttcaattcaggtatatagctgacaatagcaggataatgatcaatatagataatattaggttgttgttttgttgccatttggagtaattcctattttagtaagccattcacgcaagtttgcgatagcacccttatctgtatctggtgatgggtgtggacgatgaaaacgagcaatgctattgtttagtttaaatcgtactctggagccttcaccttgaataatctcaccacctaacccttcaatcagagattctatctctttccatttgatattagatgatgttggtgttgcgaaaatagcataaagtgtttgctgatgtttctttcgcatttgatttccctattttatgacttcaaataatgaagtcaatgtatgtgatgaaatcatattattgtgagatggttacagggaacgcaattttaatattgtggtttttcgacgagtgtcacaaaaatagtgaaaagataaaagctattgggtagttttaaccttaggcactagctcaatatttaacgctgaaagaattttcacaatggtttcaaaacgtggttttttgcttgaaagtgtttgatataaactttctctaccgatattggcttttttggctaattcattcattccttttgcacgggcaatggtatttaacgcttgaatgaattcggcttcatcaccgtcttttagcacttccgatagataaagtgcgataagttcatcgttattgagatactcagcagcatcgaacgttgatatttgcccattaaacgatttatctttcatctgattttattcctgttcaagttggtattgttgccagaatctttttgctacggcgatgtcttgctcttggctgtctttgtatccgccgttgataatgagctagatgatttccccttttcttgcatagtagatacggtagcctttgtttatcatcaatcgcatttcataaatgccatcacctagcgacttatgatctccaaaatgtccgttttttgctcgttctaagcgacggataatcgcaatttttgcaataggatctttgagttcatttagccataatttaaaggtttcagtttgttcaataatgtacataattgattttctatgattgtaatgttttcaatacaaaataacaagcaaacttcatatagtgaagtaatcacgagattgttaatttttatgacaaaaagacaagtgagagaaaatcatttttcgacgagtgtcacaaaaattttgcaaaaatcaatgaagatctcaccgcttgtagtaaacttctgcctaacaaatttgagaggaaaatgacgatggctcaacaagatgtgattgtaattggtggcggaatggtcggggcggcgacagcattggggctggcaaagctagggctaaaggttgttctgattgagaaaaatccgttgccgacatttgatccaaatgcaccttatgatgtgcgaatttcggcaattagtgtggcttccgttgcgttgttggagaaattaggggcgtggcaggcgattgaagcgatgcgggtttgtccttatgacggcttagaaacgtgggaaattgatggctttaataccgcttttcacgcaaatgatcttggcttagataagttgggttatatggtggaaaacaaccttattcagcttgggctttggcaagcgttggcacagtatccaaactgtcagcaagcggttggttttgagcaaatttctgcaagtcgtgatgagaacggtgtttggacggttgagcttgatcagcaggtgttttctgcaccgttattgatcgcttgcgatggcgcaaattcccttgtgcgtcgctggtcgggtattggtttgacgagctggcaatatcgccaacactgtctgcttgccgtagtcaaaacagaattactgcaacagagtgtcacttggcaacagttctttgaaagcggtccaagagcctttctaccgttactggagtataacggttgtgtggtttggtatgattcgccacaacgtattgctcaactgcaacagatgagcaaagagaaattgagtgcagagattcagagctattttccaagccgtttaggcaaggttgaagtgaccgctcacggtagtttcccactcacacgtcagcacgcccaaagctatgtgcgaaatgggattgtcttagtcggggattctgctcatacgattaatccactggcagggcagggggtgaatcttggttttaaagatgtaaaagccttacttgaagtgatagaacaagcggtcgaaaaagggcagaattttgcagatgaagcggtgttaaatggttacgaacgaaaacgtaagcctgataatctgttaatgcaaacgggaatggatgtgttttataaaacctttaagacagatttattacctgtgaaagtcgcgcgtaatgttgcgttaattgtggcggaacgtgcaacgccgttgaaaaaacgggcgttgaaatatgcgttgggaattatatgatagataataacatcactataattctaattataaattaggttgccaaatagatcattccccccaaactcgctaaaatagcttgcttacaaaggggagttgctatgtttagagtatattattcaaaccaaataaccgaacagaaaaatctattgactgcgatcttagcgaaagatcccaaccccgatccatttagtcaagagattgtgctggtacaaagtttaggtatggcacaatggttgcaaatgcagattgctcaagaaatcggggtggctggtaatgtgcaatttccttacccaaccagttttttatggcaacaatatcgcgtgctttttcctgatttgccgaaagagaatagctttgaccgccagtcaatgttgtggcgtttaatgcgaattattccgcagttccttgaacaacctgcctttgaagcacttgcgtcctatttaaaccaaggcgatcagctaaaacagtatcaattagcagagaaaatcgccgatctgtttgaccaatatctcgtgtaccgtccgcaatggttggtgctatgggaaaaggggcaatcgcaagcggtggttgatgagattatgcgagcggtttcttttaagcaaaaaaatgcaaaagagattgcaacgaatgtggcgtggcaaagtatcctttggaatgcgttggttgccgatataaaacaggatagcgatgaagcgatttttaatacttcacaccgtgcttatttgcaacagcgttatttcgataaacttgataatttaactgccactgaaaaagctcgcttaccgaaacggatttttatgtttggcatttcttcccttccccattctcagctcgccgtattgaaaaaattgagtgagcattgcaatgttcacctctttttcactaatccaagtatggaatactgggcaaatgatcgtgaagataaggtattagaaaaattagcgttaaaagataatttatctgaagcagaattagcagagttatttgaaaaacaaggaaacccattattaacagtttggggaaaacaaggaaaagaatttttaaatttattaactgaaacaggtattcaagatatatcactttataatcattttgaagataaaaatccgacattattaacccaagtaaaaaaagcgattttatattcagaacaccaaactacattctctttagctaatgaagatcgctctattcagcttcacacttgccacagcaaaatgcgtgaagtagaagtattatataatcaattattatatttatttgaaacctatcctgacttatccccgaaagatattattgtgatgtctgcggatattgatagttatgcaccttatattaatgcggtattttctcgttatgaaaaagagagaagatatattccctttaccttatcagatcaaaaaattagttatattaatccaattattgctagctttttacaattgttatcgattaaagaaaataaattctcagcagaagagatattagatctctttgatatttcagctattcgagaaaaatatcaatttaatgagcagaaaattaatacattaagagaatggattaaatcggttggcattagatctggcttaaaaatagagaacccagaatggcaaaattataattcgtgggaaaatgggctaaaccgattattgttaggcacaagtttaaaagcggaaaataatggctggcagaacattttagcttttgatgaaagttatggattaatctctgaattaacagggaatttagcaaaatttatcgacaatctcaccgcttggcacgcctttatttgccagccacagagcctatctgcttggcaagaacagctgtttacccttgtggcacagacctatcaagaaaacgatcaaagtattgatgcgattttgacgttacagcaggctatccgtgatgtgattgagcaaattcagcaaagccattttgaagaagcgataggtattgatgtgatgcttgagctatttactcaacagctgagcgaacagcgtagccacttaaatttccttgtgggtaaggtgaatttctgtacgttattaccgatgcgagcaattcctttcaaagtagtctgtttgttgggtatgaatgaaggtgagtttccacgccaacagacgatcaatagttttgatttaatgcagtacgtcccacaaaaaggcgaccgctcaagacgagatgatgatcgttatcttttccttgaagccttgctctcggctcaacaaatgctctatattagttatattgggcaatcgctcacaagtagccaagaaaaattaccatcagtgttggtgacacaattatttgattatttgaaagaaaacctgcctaaagctgactatactaaattattgtctgtccacccaatgaccgtatttagcccaaataatttcaaagatggcaaagtggcttatgataaagagtggctggaagttaaaaataatattttaccacgcaaagatttcttgcagaaattaactaaaacgcaggaagatataatgtcagatattccacttaaccagtttattcattatattcaagaaccaataaaatatttcttccaacaacaattaggggttcgttttgagcagaatgaagataaaattgaagaaagtgaaattttccaattgtctggcttagaaaaatataatttacttgatgatttaattcaagtcgaagaacaagatattgaaatcttttttgagaatgaaaaattaaaaggcaatctacccgctcgttattttgcagagattaataaaacaaaactcaccgaagatattcagcttttaagaaatacgttatcttcttatttgtcgcaagagaaaaacgttattgaaatagaacactctgttatttttgcagagagaaaatatcaacttgtaggtaatgttccaaattgctttaataatgaagtggtattatggcgagtagggggattgcgagataaagatattattcaagcgtggatttattatttgttattaaaagcaaataatcaccctattctttcgctacgtttttattatcgacaaggtgaaaaagcaaattacctaacctttaatgatatttcgcaaacagaagcaacggagatattaaatctttatttacaagattatttggcaagccaaacagaattaaaatgggcacttagtgatagtattacagaatactttaataacaagaataaagaattggatccatcaaaaatcttaaaaaagatttttgatataaataaaaatccctatctgactcgtatcactgaacaatctgaagcgttagatctaacaacaatctctgacagaatggaatcatggttcagtttaatgtatatgagcattaaaacttaatacaaggacagtttatctaataatcactttattggttgtatttttcttaaacagtagcataaagcaagcactaatatgtcttctgtatttcactatagagataaatctgacaaatataatatctatttatatttttgcctgttagtttgataaatagtattgatgttgctaatactctataatacgtctataactaattacccatgaaggatttctatgaataaatcaaaaaaaattggtgtgctattagcaaacttaggcactcctgatgaaccaactactccggcagtgaaacgttacttaagacaattcctgagcgatccaagagtaattgatttaccgaagtggcgttggaaatttattttgaactgtcttgtgttacctaaaagagtacctaaagttgcacaggcttataaaactatctggacagaagatggctctcctttattatctatatctcgtcaacagcaagccgctattcagacttatttttgctcacagaacaacaatattgtcattgaacttggaatgagttacggtaatcctagtatccagagtgctgttgatagccttatagcacaggatgtagaaaaaattattatacttccactctaccctcaatatagctcaacaacaacagcctcagtgctggatgcttttgcacaagcattatataaacacaagaaagttttgccttttgaatttattcacaattaccataatcaccctttgtatattaaagcattagcaaatactgtaacgcttacagagaatgagctattacttttttctttccacggtatacctgctcgttatgaagcagaaggtgacttttattcagaacaatgccgagaaactgcccgtttagtagccaaggagctcaatttgacagaaaatcaatggcttttatctttccaatctcgttttggtagtgaagagtggcttcaaccttataccgatgaacttttatcgaatcttcctactaaaaatataaaaaacatagcggttatttgtcctggttttgccgcagattgccttgaaacaattgaagaaattgctgaagaaaatcaggaaaattttaaaaatgcaggaggaaataactacagatatatttcagcattgaatgcaaatagcgatcatattagctttttagttaagttgattgagtcaaagctagactgagaatatatctgttaatttgtttgatagatggtgaagtatccccctaactacaatctgtgtctgtatctgaagtgacaactataagatacagacatttttatatctccatagtcaaattagataattattttttataataaaaaaataagctcataaaatcagcaaataaccctcttacctaactcaaaaatgagaagtagatcacatttttatataaatcagattgctgaaaaatcggcatcctttaaaattccactccgaaatttactctattgagaataagttttaataatccgaataaatcctcacataaggagcaaccaatgagtattgctattatcatagcaacccacggtgtcgccgcagaacaacttctcaaaaccacagagatgttaatcggggaacaaagtgatgtagccactatcgactttgtacctggtgaaaatgccgaaactattatgggtaaatatcaagagaaattagcgaatgagctcgctcactgcgatcaggtgctattccttgttgatacttggggcggtagtccgtttaatgcggcaaaccgtgtgtctgaaggcaaagagaatatggatatcgtcacaggtgtaaacgtgccgatgctcgttgaaacctttatggcacgtgatgatggtccgtctttatcagaattagtggaagtcgctcttgaaacaggacgtttaggcgtgcgtgcattacgctatcaggagaaagaagaagcacctgcggaacaacctgctcctgctgctcaagctccggtacaaccacaagtagctcaagtcaatcaagaagggaatttagtgattggtctggcgcgtattgacgaccgtttaattcacggtcaagtggcgactcgctggacgaaagagagccgtgttagccgtattgtggtagtgaacgatgatgtggcaaaagatagtgtgcgttcaacgatgctaaaaagtgtagcaccaccgggagtaatggctcacgttgtgcctgtggataaaatgatccgcgtttataacaaccctgaatatgcgaacgaacgtatgatgttacttttcactaatccgacagacgtggttcgtttaatggaagcaggcgttgagttcaaatcgatcaatatcggcggtatggcatataaagacggtaagaaaatgattaccagtgccgttgctgttgatgataaagatatcgaagcatttaaagcattagatgcgaagggtattgagcttgatgtgcgtaaagtatcgaatgatagccgtcaatatatgatggatttactcaagaaaaataacttaatctaaggaaattattatggaaatttctacattacaaataatcttagtattccttgttgcctgtatttcaggtatgggatcaatccttgatgagtggcaaactcaccgtccgttaatcgcttgtaccttaatcggtatcgtattaggcgatatgaaaacggggatcattgttggtggttcattagaattattagcgttaggttggatgaacattggtgcagcattagcgccagatgcggcattggcctcagtggtttcaaccatcttggttatcgtaggcggacaagatattccgacagcgattgcactcgctattcctcttgcagcagcaggtcaagttttaacttatgttgtacgtgcgattacagttggtttccagcacgcagcggataaagccgttgaaactggcgacttaaataaactggattggatccatcgttcagcgttattacttcaagcaatgcgtattgcaatcccagcgttaatcgttgcgatgacagcaggtacggatactgttcaatctatgttagcagccattccaccagttgtaacaacaggtcttaaaattgccggtggctttattgcggttgtaggttatgcgatggtgatcaatatgatgcgagcaggtcacttaatgccattcttctatgcgggtttcgtaattgcagcatttaccgatttcaaccttgttgcattaggggttttaggtactatcacggcgattatttatatccaacttcacccgaaatacaaccaaagtaaacaagtggtgcaagtgcaagcaacaaacaacgaccttgacaacagattagactaaggaagtaagactatgacaactgaaatcaaaaaagtaacacagagcgatttaaatgcggtggtacgccgttctaatctcttccaaggttcttggaacttcgagcgtatgcaggcgttaggttttgcctactcaatggtgcctgttatcaaacgtttatatccagatccaaactcacaagaacgtaaagatgcgatcaaacgtcaccttgagttcttcaatactcaaccattcgtagcggctcctgtattaggggtaactatcgcaatggaagaagagcgtgcaaacggcaaacctatcgatgatgcggcaatcaacgggatcaaagttggtttgatggggcctcttgctggtgtgggcgacccgatttattgggggacagctcgtccagtattcgcagcattaggtgcaggcgttgccttaacaggtagcttattaggtccactactattcttcgtattatttaaccttgtgcgtttagcaacccgttactacggcgtcgtttatggttacaaaaaaggcttaaatgttgtacaagatatgagcggcggtttattacaaaaattaaccgaaggtgcatcaattctcggcttgtttattatgggagcgttggttcagaaatggacaagcattaatgtaccgcttgtagtttctactattcaaaaacaagacggcacaacggaaattaccaccgttcaatctatcttagatagcttaatgccgggcttattaccgttacttttaacatttgcgtgtatgtggttattacgtaaccgtgtgaatgcactttggattatcgttggcttcttcgttatcggtatcttcggtgcgtggacaggtattcttgcataatttgcaaaaaatccgataaattagaccgcttgtgctaaaatacaagcggtctttttttaagaacattctacaaatgacaaatatacttctgattttagctattggtttgagcttgctctatattctctatgatcagctcattatggacagacgaaaaggcgaaactcgattaagcgtgccgttagttcgacaagcaagtttagacacagggattttaattgccctaattgtgttaattatcgtgcagggcgtacaaacaggtattgaacctctcactgtattcttattgtgcggttgtattgtcttagcagtctattcggcgttcattcgttaccctcgtttactattaaaagaacaaggctttttctttggcaatttctattttttatatagccatattgcacaaattaatttggcagatcagaatattttagtcattgatctaaaaaataataggcgattgtttattcggattaaacaaaaagaagatattgaacgagttgtcaatttctttggaggatacaaaaaatgattttcaaattagtgggtaaacatcaacattatgattggggtggagatattttcatacccaactggttaaaacttgacactcacgaagagaaaccctatgcagaatattggcttggagcacaccgttctgctccttcaatgattgaatttgaaggagcatggttgcctttagatcgcgttttagataaggcgcctcaaatactaggagaaaaatcgcgtgaacaatttggagatgaattacctttcttactgaaaattttggatgtgaagttaccgctttcgattcaacttcacccaactaaaaaagaggcagaacacggttttgaacgtgaaaattatgaaggtattccactaaatgcctcaaaccgcacctataaagatcgtaatcataaaccagaaatgatgattgcattatcagacttttggctattacacgggtttaaatctgaagatgcgattaaagaaagcctaatgaagcatcaatctttacaaggtctggcgaaagcgattgaaaaacaaagtttaccaacggtttatgcctccattatgcaagcagaacaaactcagcttgcagaatggttattgcccatcattgaaaataaacaagaggattatcaacaagatagacttaaactagacgatcctgactattgggtactatatactattgatgcaatgaaaataagtctggataaactagatgcagggcttctctgtttctatctatttaatattgtaaatctcaaaaagggagagggaatttatcaaggcgcaggcttacctcacgcctatttgcgaggacaaaatattgaactaatggcagcctcagataatgtcattcggggagggctaacccctaaatatgtagatatcccagcacttctacatacgattgattatcgagcaattacacctaagattattcctcaatatgaggaaaataatagtgaagagttactgcacttatatccaacaccagaagcagaggactttgccttacagcgactcagctttaaaccatttgatgaagaacaatttactgcaacaagtgcaagtattttattagtaatgtctggaagtttgtatgtcgatttaggatatgactcgatttatttacaacaaggcgaagcaatttttatcagcgctaatagccaagtagattttattggtgaaatggatggctatgccgtgattgcaacactgccgtaattgtgttcatttttttctactccctatcctatgttctatcttttgcccgatttattcttcttttcttaaaatcgggcagtcaaaaaacgaaaacctttgctttttttgtgagctgaatcacaaaaactaaattacttcgtaaaatttctttttattcggtcaattttgtttgaatatacggttgttttctcaatagagatagccgataaaataatcacgatggaggcagagatgaccgcagtcaatagcaatacgccgttactctcaatgaagaacatcagcaaatcttttgtgggagttcaagccttaaagaatgttcagcttgaactacataaaggagaagcccacgctttaatgggtgaaaacggtgctggaaaatccaccttaatgaaatgcttgatcggggtttatcaagcagatgaaggggagatcatctataaaggcaaagccgtcaattattcttctgtgttggaagctcagaaagacggtatcagtatgattttccaagagttaaacctcattcctcatcttaccgtggcagaaaatatcttctttgcccgtgaaccaaataaatttggcattgttgataaagccaaaatgaataaagatgccgccgacttgctcaatatgtttgatattgatgtgaagccgaccgatctagtcaaagacctttccgttgctcgtcagcaaatggtggaaatcgccaaagccctctcttttgatgtggaagtgttgattatggacgaaccaacttctgcacttaccgaaaaagagattgagaaattatttgaacttgtccgccgcttgaaagagaaaggcgtgtgtatcgtctatatttctcaccgtatggacgaactaaaacagatctgcgaccgcattaccattttccgtgatggtacttatgtatctagccaccgtttttcagacatcacgatggacgaaatcattaccaaaatggtagggcgtaccctcgataatcatttcccaccaaaaaccgccaaaatcagtgatgagttattactttcagtgatgaatgcagaacgtaaaggcgtatttgagccgttaaactttgacttgttaaaaggcgaagtgttggggattacaggcttagttggggcaaaacgaacagaacttgcccgtgcgatttttggggcagatcctcttgatggtggcgaaatttatgttcggaataagaaagtggttattcgtgacccaagcgactcaattaaagcaggtattgcttatctgtcggaagaccgcaagctaaatggggtggcagtgagaatgtctattcgtgagaacatcacaatggcttcaatggataaagtatgcgatcagctgggcattatttcacataatgaggagctgaaagcgagcgatacctttattaagaaaatggaaattaaaacgccaacacctgagcagttagtaaacaacctaagtggtggtaaccagcaaaaagtggttatcggcaaatggttgttccgtgatgcgaatgtaatgattttcgatgagccaactcgaggcattgacgttggggcgaaatatgcgatttatcagttaattgatgaacttgccgccaatggtgtcggtgtgattgtgatttcttctgaattacctgagattttagggattaccgaccgtgttatcgtaatgcgtgagggcagaatgacaggtatgttggaaaccaagaaaaccaaccaagaagagattatgcaatatgccactggcgtgagaaatatgttcaaaaacgaatataaaaactaaggagctttaaaatgagtgataaatataaagatctgcttcgcaaaatggcggcattggcagggttaatcctcttagtcattttctttagtgtaaccaacgactatttctttacctctaacaacattatgactgttggtctgcaaacatcgaccattgcattaatcggtatcggtgcaacttgcgttatcttaacgggcggtatcgacttaagtacaggttctgtagttgccctttcaggggttgctgctgcaatgattgtaaacgcaggcgtaccggtgccgttaggtatggtgttgggtatcttagttggcggtatctgtggtttagtcaatggtattttagtcacccaaatgaaattaccgccatttatcgccacactcggtatgatgatggttgctcgtggtttagcactctatgtcactaacgctgctccagtttcaggtatgccagaaagtttcgcagccttaggtaacggtgctttattcaaaatcatagaagaaggtccgaacggcttaccgaaagtcgtgtttgcaggtatcccgtatcctgtgattattatgatcttcatcacggtactctttacctttgccttaactaaattaaaagtgggtcgctacatctatgctatcggttcaaatgaagaagcggctcgcttatctggtatcaaaaccaatgttgtcaaaatttatgcctatgttgccagtggcttactctctggcttaacaggcgtaatccttgcttctcgcttggtaacagcacagccaaacggcggtgtggcttacgagctagatgcaatcgcaagtgcagtagtcgggggaacatcgttgatgggcggtgtcggtaccatccctggcacattaatcgggtcattcattatcggtgtactccgtaatggtttgaatatgaatggcgtatcatcgtttgtgcaaatgattgttatcggtttggtgattatcgtagccgtgtctttagaccagctccgtcaatctaaaaaacttggtaagaaataaactctagaggagatttaactatgaaaaaattagcaatcgtaaccacaactgtattaggtttatctaccctttttgcaggcttagcgtgggcaaaatcagacgaaattgcagtcatcgtaaaatccgctaactcaactttctggcaaaacgtgcgtaaaggtgcggaaactgcaggtgcagatttaggcggaaaatataaagtgaccttccaaggccctgaatcagaaactgcgattgacgcacaagtcaatatggtggacaacgctgtgaaccgtggtgttgcaggtattgtgcttgcggcttctgacccagtggctcttgtgccagcagtgaaaaaagcctatgaaagtggtattccagtagtattaatcgactcaggcttaaacagcgatggtaaatactatcaatcattccttgcaaccgataaccgtgcagctggtaaattagccgctgaaaaattattagccaaagtgaaaggcggtaaagtggcagtgatgtcattcacccaaggtgcagcttctgcgattgaacgtacaggcggcttcattgatgaagtgaaatctaaagcagattacaaaattgttggtccatactactcaaattcagaaatggttaccgcattgaaccaaactgaagacgtgttaggttctaacccagatcttgcagcaatcttcggtgcaaacgaaccaaccgcagtgggtatggctcgtgcggtgaaacaaaaaggcttcgcaggtaaaatcgttgccgttggttttgatggtaactcagaccttcaaaacttcgtccgtgacggaactttagacggtatcgtggtgcaatcttcataccaaatgggctacaaaggtgttgatactatcggcaaaattattaaaggtgaaaaagtcgagaaagttattgatactggtgtagtttatgtaacgaaagaaaacatcgactctgaagaagcgaaagcggtgctttactaataaaaatctccccctaccccctctttttcaaagagggggaatatcaaacttccccctttggaaaagggggaatgagggggatttcgagagggatcaagcggtctgttttcttctgaattttacgcttacgccctctcccttgtgcgtatttgaacttgtaaattttaagaggaaaaacattatggcaaatcgtcttatccttaacgaaaccagctatcacggcaaaggtgcaattcaacacattgttcacgaagtaaaaagccgtagtttcaccaaagctttaatcgtcaccgacaaagatcttgtgcgttatcaagtcgtagcaaaagtgactaacttacttgacgaagcaggcttaccttatgaaatttttgatgaagtgaaagcaaacctggctgtttgtgtcatcaaaaaaggggtagaaaaattcaaagcctctggtgctgactatatgattgcaatcggtggtggttcacctatcgacagtgcaaaaggtatcggtatcatcatcaacaacccagaatttagcgatgtcctttcccttgaaggcgttgcaccaacccaccaaaatgcgtgccaatcattgccgtaccaaccaccgcaggtacagcagcagaagtgacaatcaactatgtaattaccgacgaagagaaaaaacgtaaattcgtctgcgtagatgttcacgatgtgccagccgttgccgttgtcgatccggatatgatgtcatcaatgccgaaaggattaacggcagcaacaggtatggacgcattgacccacgctatcgaaggctacattaccaaagcggcttgggaattaaccgacgcacttcacctaaaagcgattgcattgtgataccctgtttgcctattgcctcaagtgcagcggttaagcctgatacgccgtctgcgatttggctattgtgttgaatgtagtttggtgcaagcaagctgcaagctttggcactgtcgcccgatacaaaatattgattaacgcttgtgcattgcggatattgtttgtttgaacttgggctgtcattgtcgtgtttccttttgttgatacagttgattgtggattttgggcataagctgcggttgccattgctaatgctgaaacgaaaagtgcggttgattttttcattgctttttcctttgttaagttaatgcgatttgccaaactggctgatgtggcgtattatagattaaaacttacttttgagaagtacttacaaaaatgtaagaaatgaagatattttgtaatctattgaaatataaggaaataaaaatggaaaaattttcaaattcaatcgaacggggttatgtattatccgctcaatgcccttctcgtgagattttgcaacatctgactaaccgttggggcgtgttggtgatgattgtgttgatgaaaggcacaaaacggtttagcgaaatccgccgtgagattgacggcgtgagcgaacgtatgctgacccaaacgctacaacagttggaacaagatggtatgctcaatcgtaaatcctacaacaccgttccgccacacgttgaatattcgctgacggattttggcttacaggctggcagtcgccttgtggatttggtggactggttggaagagaatttgaatgggattttgaaaagccaaaagaaatagctaattgcaagcagtgggatttcttatggattttgcaattgtaaaaatttgtggaaatttgaccgcactttttatcaactcccccaacagcccccgataaatctctaaatccacatctttaaacacattaaacactaccttcatttgcgggttatcggctaaaaaggctttgacagtttgcacggcgatttctgctgcctcttgattagggaaacgaaattcgcccgtgctgatgcaacaaaaggcgacactctcaataccgtgttgcttggcgagttctaggcaagagcggtagcaactggcgagcagttcgcaatcttttgccgataacgcaccactgataatcggccccacagtgtgcaaaacgtaggcagacggcaagttaaatgctggggtgatttttgcttgccctgtgggttccaaatgcccttgtttttccatcaattcagcacaagcaaggcgaagttgcacgcctgcttgcgagtgaatggcgttgtcgatacaggcgtgcaaagggtgaaagcagccgagcagttggctgtttgcccctgtacattaaacctgccaccgcaccagtttcatcgtgcagtcgtcaaaccgcagcaccaccgaataaaaatcaaaaaaatcgtactccgtttcctgcaccttgccataattttgcaaggctggagcaagctgaaaataaccgtgaatggcttgctgccgattgtcaaacgtcacttcttcaagataaaaacggtgttgattatgggtaatcgttttggcaaaacggaatgtaccgaaatgcagtaagcgtgttttttttgcgaatagcgaaaataaaaattaagctaaaaataaataataagataaacagcatttttacttcctaaaagtaagtaaattgagggcagtatagatgtttaacttattttatggaagtacttacaaaaatgtaagattttggatttatatttaacttattgatttaaaagaagttaaattttagattttttaggaaataggtaaggatagataaaacaagcagtggcgtttggtgtcgattttccataattccagtaaatatgacaaccttacaatacactatacgcattaacagaaataacacccgaaaaccgttgctaaggaaacactcaaatggatttaatagatttactgtttgtgttaagattctcaaaatttcgcttgaactgatagagcttatgatgaactatgctgaatccattatcgaaaataaactaataaagaaattacaagatttaaagtatatttttcgagaagatatttgtgacagacaatcactggaggaaaattttcgtgagaaatttgaacagttaaaccgcgttcgtttaaccgataccgaatttgagcgcttgaaattggaaattatcacaccggatgtctttgccgctgctaagagactgcgtgaaactagcacctttatccgcgaagatgacacaccgctcaattatacgctggtaaatatcaaagattggtgcaaaaacgactacgaagtgatcagccagctgcgtatcaatacggaaaacagccatcaccgctacgatgtgattttattgattaacggtatacctgttgttcaaattgagctgaaaaccctgcaaattccacccaaaaaagccattgagcaaatcatcaattataaaaatgacacaggcaacggctacggcaacagtttactgtgttttatgcaattgtttattgtgagtaatgagagtagtacctattactttgccaacaatcaaaacaaacatttcgcttttcagacagacgaacgttttttaccggtataccgtcttgccgatgaagcaaacaataaaattaattacttgtatgattttgccgataaatttttggagaaatgcacattaggtaaaatgattagccgctatatggtattggtggcaagcgaacaaaagcttttaatgatgagaccatatcagatctatgccgtcaaagcgattgtagattgtattcaccaaaaccgaggtaacggctatatttggcataccacaggttcaggaaaaacactcacttcattcaaagcctctacattgctcaaaaataatcccgatattgataaatgcttgtttgtagtagacagaaaagacctagaccgtcaaacacgtgaagaatttaaccgctttcaagaaggttcggtagaagaaaataccaatacttatactttagtcaaccgcctgctttcagatgattacgccgataaagttatcgtaactaccattcaaaagctggggttggcactcaaagaaaatagtacccaccatagacaattaagcacactcaaagataaacgaatggtttttatttttgacgaatgccatcgctcccaatttggagaaaatcatcaggcaatcaagaaatttttcccaaaagcacaattatttggttttaccggtacgccgatttttgaagaaaatgctagttacaaacgcattaacggcacggacgcatcttatcaaaccacagaagatatttttgaacagcaattacatgcttacaccattaccaatgctattgatgacggcaatgtattgaaattccatattgattattacaaggcagagggagataagcccatatctgccaatcatcccataaccaagcaggcgattgttgattccattttaaacaagcacgatgccgccacttccaagcgtcgtttcaatgctatttttgctaccgcatccattaatgatgcgattgactattaccgcattttaaaagaagcacaaaccaagttgcaggcggataatcccgatttcgtgccgcttaatatcgcctgcgtgttttccccacccgccgaaggcaatcaagacattgcccaaatccaagccgatttaccgcaggaggaacaagacaataaagatgatccgaacggcaagaaagccgccttaaaagccattattgatgactacaatgcacaataccgcaccaatcacagtatcggcgaatttgatctatattaccaagatgtgcaaaaacggattaaagaccaccaataccccgataaagactatccgcaccgcaacaaaatcgacatcactattgttgtcgatatgctgcttacagggttcgacagcaaatatttaaataccctttatgtagacaaaaatctgaaatatcacgggttaattcaagcgttttcccgcaccaaccgcgtattaaattctgccaaaccctacggtaatatcttggatttccgcgggcagcaggcgcaagtagacgaagccatcaagcgtttttcagggcaagaccaagaccgagccaaagaaatctggattgttgatccggcggaaatcgtcatgaccaaactgcaaaacgccatgacgcaactggaagatttcatgtcatcacagggattggcctgtatgccgtctgaagcgcataacctgaagggcgacaacgcccgtgccggatttatcaatctgtttaaagaagtgcagcgttacaaaacccagttggggcaatataccgatttaagcgaagagcaaaagcaggcaattgaaaatattttgccaagcgatacccagcgcgcttttaagggcgtgtatctggatatggcgcaacaaatcaaagaacaagcgttatatggaaaaacgtcaccatcgccggagcttgagcaattagactttgaatttgtgttgttttcatccgtaaccatcgattacgactacatcatgaaactgattgccgaaaactcatccaaaccgaaaaaacagcagatgagccgcaagcaattggcggagctggttgccgccagcagcgatttgatggatgaaaaagacgacatcattgcctatatagacagcctgaaagcgggcgaagcacttaacgaacaagaagttaaagccggctatcaggcattcagaaacgcaaaaacaaacgcaaaactgaccgcacttgcgcaaaaacacggtattgcaaccgatactttgagaggctttatcgaagaaatcctaaaccgcatgattttcgacggcgaaaagctcaccgatctgctcgaacctttggaattaagctggaaagaacggcgcattaaagaattagccttgatggaagatctcgttcccttgctgaaaaatatggcaaaaggaaaagaaatttcgggcttgaaggcatatgaataaacaatctaggaataaataatatgctgacacagcaagaggcagatgcattattgacattgggaaaatatgatttcagcgatggagaatacaaatttccctatatgggcggttcattacgcttatcgttacagtcaatggataaaaaagaaacttttaacttggatgtaaccagaggatatatcgcattggaaaaaatcaccttccaaaccagagccagaaaagccgttgtattggttcgcctggatattgaaggcccgccgcaccgcaatcctgatggtgaagaaattacttgcccgcatattcacctctacagggaaggctacggcgacaaatgggcttatccgctgcctgatgaactcaaattagtgttagacagcccttatgatctactggatagatttatggattattgtcatattatcggcaagcccatgattcaaagagaattatttatatgattgacgaaatacaaagcctgatggagcaatacctccaatggctgaaagacaaaacggctttaaaacaaatcgataaagattgggtgcaggttaccactccgcatttggatcgtcataacgactgtttgcaattttatatccgcaaagaagccaacggttttttgctcagtgatgatggctatatcattcacgatttaatcagctccggctgttctttggatagcgaaaaacgcaaagcattattgaaaatgactttggcaggattcggtgtccagctcgacggcgaaaccttgatactcaaagccagcgccgaaaatttcgccttgaaaaaacataatttcctgcaagctatgctggcggttaacgacctgttttatttggcttcgccctacgttgccaacctgttttatgaagatgtggtgcaatggctggatcactcggatatacgctatacccccaatatcaaatttaccggcaaaagcggctttgaccatatgtttgactttgtcatccccaaatcgcgcaaacaacccgaacgtatcttgcaaacgctcggcaacccgaaaaaaaatgccatcgaagcaacggttttcaaatggacggatagtcgtgaaaaccgtgcggccaattccgaattatttgttttgctcaataacgaaacggaagtcgcggcttcggcgattgacgcacttaaaaattacgatatcgaaccgattttatggacagaacgcagccaagttgtagaacggctggttgcctaagcaatatacaaatctaagagtataaaaaaatgaatgcttcagaacagaataagccaaaccagcaagaaagagtgatcccaaaacttcgttttcctgagtttcagacggcattggggtggagttggaaaactttagatcaagtttgtaccattacgaatggtaaatcgaatgcccaagaccatattgaaaatggcaaatatcccttatttgaccgttctgaaattataaaagcgtcaaatgactacttatttgattgtgaggttgtgattattccaggagaaggaatgaaatttattcctaaatactacaaaggaaaattcaatcttcaccaaagagcatacgcattaaaagattttattattaatggaaaatttgtttattactctatgctcaataatactactctcttatccaagaaggctgttcaatcaacagtactctctcttaggctgccaattttaaaaaattttccaataattaaacctgaaactgaagaacaacaaaaaattgccgattgtctttcttcgcttgatgaattaatcgagttgcaggaacaaaaacttgtcgctttaaaacaacataaaaaaggcttgatgcagcaattattcccaagccataatgatttgcaagcaagcaagcaagcaagcaagcaagcaagcaagcaagcaagcaagcaagcaagcaagcaagcaagcaagcaagcaagcaagcaagcaagcaagcaagcaagcaagcaagcaatagtctatccgaaacttagatttccgcaatttagaaattgtaaggggtgggaggttgttgagttgagagatgttggagattttgtgaaagaaaaaatagaagttataaatttagaaccccaaaattatatcagcactgaaaacctattatctgattatggtggggtaacagcttctaataagttacccgcaacagaaaaagttactgcatataagaaaaatgacattttggtttctaatatccgaccgtatttgaaaaaagtatggcaggcagataagaacggtggggcttcaaatgatattatcatcattagggcaaaaccaagtataaatatatcttttctgtcatttgcgattaaaaatgatgattttattgactatatgatgaaaggtgcaaaaggcgtgaaaatgcctaggggagatttaaatttaatttctatttttcccgttgcagtaccgacctcacccaaagaacaacaagccatcgcagattgcctgtcttcactggataatctaattaacgaacaaaacgaacggataggccgtctgaaaacccataagaaaggcttgatgcagcagttgtttccaagtatttaggagcgatgatgagtaataatcaagtaaaaataactagatataaaaccttgaagagacttgctactagaattaaagatgatctcaataatcaaaattttgttttactctatgcctataatggtacagggaaaacttgtttgtccatggaggttaaagctcagaatcagagaaagaatggtaatgtaagcaatactctgtattttaatgcgtatactgaggatttattttattgggataatgactttattaatgatgggcttgaaccaaaattatttattaattctgaatcaaggttttttaatggtttaaaagatctttcattagaagataaaattagattttatttagatcgctatgcggaatttaatttcataattaattatgatagttggtttatttctttctcttatccagatgagccagataaattgattaaaatttcacgtggtgaagaagttatctttatttggtgcctctttcttgctttatgccaattagtttatgaaaagcatgaatcttatcaatgggtaaaatatatttatattgatgatcctgtctcatcgttagatgataataatacgattgccatcgcttgtgatttagcaaaactattaaaagataataaagataattttaaagccataatttcctcacatcatggactattttttaatgtaatgtgcaatgaattaaaaaaacaaaatcataaaaatattttttatataaaaataaaacaactagtcaattttatcttcaggcaacagacgaagtacctttctttcatcatgttgctaatcttagtgaactacaaaaagcgataaataataatcaaatttatacataccacttcaatatgatgagaagtattttagaaaaaacttcaagttttttaggttacaatgatttttctgattgtttaagtggtattgatgatgaatttctatatgctcgtgctttgaatttacttagccacggaaatcactctatttatgagccgcgagagatgaatgaagataataaaaagttgtttaaacaaatatttgaaaattttttaacaaaatatccatttaatctacctaatttaacagagatacaaccatgacccaagagcaactcaaccaactgggcaaaaccttatggggtattgccgaccaattacgcggggcgatgaatgccgacgattttcgtgattacatgctatcgttcttgtttttacgctatttatcagataattacgaacttgctgcgcaaaaagagctgggtagggattatccgcaattaagcaatgatgataagcgcacgcctttggcggtatggtatcaagaaaatgctgactttaccgccgattttgaaaagcaaatgcgacgcaaagtgcattatgtgattaagcctgaatatttgtggggcagtattgccgaattggcaagagtgcagagcactgagttgttaagcaccttacaacagggttttaaatatatcgaaaacgaatcttttgagagcacgtttggcgggctgttttccgaaatcaatctgaattcggaaaagttgggaaaaagctatacggagcgcaacaacaaattggctgaaattgtcaaacgtattgctgaaggtatcagtgaattttctgccgacagcgatgctttgggtgatgcctatgaatatctgattgcccaatttgcttctggttcaggtaaaaaagcaggcgaattttatacgccgcaacaagtttccactattttatcgcaaatcgtaacgctggatagccaaaaccccgccagcggtaagaagaaaaaactggatagcgtgctggattttgcctgcggttctggttcattgctgctcaatgtgcgtcatcaaatggcggaaaacggcggacatatcggcaaaatctacgggcaggaaaaaaatatcaccacttacaacctggctagaatgaatatgctgttacacggggtgaaggatacggaatttgccattcatcatggtgattctttaatcaatgattgggatattctgaatgaaatgaatcctgcaagaaaactggaattcgatgccgttgtcgccaatccgccgttcagctaccgctgggatcccaaagaagatttggccaatgatttccgcttcaacggctatgggcttgctcccaaatcagctgcagattttgcctttttattgcacggattccactttttaagtgataacggcacaatggctattattttgccgcatggtgtattgttccgtggaggggcggaggaaaaaatccgtaagaaattgctgaacgatggaaatatagacgcggttatcggattgccggctaatttgttttattctacagggattcccgtctgtattttggtgttgaaaaaatgcaaaaaagaagacgatattttatttatcaacgcagctgatgcctttgaaaaaggcaaacgtcaaaaccgtttgactgacgagcatatcgcaaaaattatcgaacattatcaatatcgcaaagaaacacaaggctatgccaaacgcatttccgtgcaggaaattgaagataacgactacaacctaaacatcgcccgctatgttaataataccgctgttgaagcagaaattgatttggccgccaatcatcaggtattgatggatttggatgcaaaaatcaaagttgcaacagctaaacataatgtatttttgaaagaattggggctagcgttgttaccttaaattcattttaatacatctccacacgaatttaggtgctgatgtaagttagccctaaatttcaggcatagcaaccatttttactatgtcagttttaatgcatatgctatctcatatagttgcgattgatgcttttttcttaattttcgcatcataatctccactatatgaaattgacacatctgtactggcgtattaaagaaatctttcatcaaaccactccaaccatcgcaggtaattgattgaattatatagcctttttctcttactcaatttttccgggctttagcaaaatggacaatttttcattcacatatcaaaaaggagacctaaatccttgtgctataaggcttcaaatcactttttagcaactattttgtctactataccgattaaatttaacttgcaaagtttttatagaaataaagcgcttgtgatacattaatcccatatcttagatattttattctggttattcatataattcaccttaaatacctttaatagcagagtaccaaaataaaccgcattcatcagcataaaaaactctcgaataccgttaaatactttcacataaatatcatcctgaattggcataatttctttataaatacaaaacaaaagaaaaataagaaagcagaatatggtgatcttttctcgatgtttatgcgaaagaaatcttgataaagaatagctataggttaatgcagctcccattaataaccatgataaaaaagaaattatagcgtcaaaaaaccaaaacaaggaaatattgtttattgccagaaaaagataaaaaatccaaatcattaatgaagcacttaaataagtataaataaaataaagtttattcatctttgaaagtttattaaacttgatcttctcctaataatttatgaaataacattacctatttaaagtataaaaagtggcataaattttcatttatgccatccgttcaattaatgagccatttttgaaacgaaataacttgtaggtgcaatcacatcatacccattgtttttagcttagcatacattgtttcgattgattcaaggctagaaacgatcaccttaagccctgtttgcttggtaaaatcatcaagcaaaccttcaggtacgtattcagaccaagtatagagataggcggtatcgccttttgctactgcttgatggcttgcaaatgccaatgtgaccgccgataaaaccattgcccattttttcatatttttgttctccaaatatagagagaaatcgtccttttatatagaccaaagtcgcataaaaacttagccattcaggcgatgcggattgtaggctaattaggggggaatgcaagaaaatttagtggtaataaggataaattacaagcggtgggatttgggaaaattttgcaaaatacacaagaggtgggaaaaagatagtgtaagtatgggcatttgtgctatctggataaaaggttaattcgtaccatgttcttcaaattttatcgtttgttacataaaactagagttgtgaaatctttagtttgttctaccatgctcaaaaatatatctgctatatctatgaataagtttcttagttacgcacaaccttgcagttttttatgcggaagatggagtataaatcaattcaacaaacctgcaaaatcaaacagagaacttttacaacaatggaaagaaatccctgatgaagcttgttcaaagcgctatttagaacatatcagctattatcgtttttcagcttatactattcctttccaacaattaaatatccaattttagttgctacccaagccttgctttataccatcagactagattcaaaaagaatatatggatatcccacaaaattggaaattagatagtttttgggatagaatgctaagataaaaggcatagtagacaaaatggttgctaatgaatatttttaattattcttagcaactctttttatttaaaaaaaatcctttataaacatgatcttatgtcttttcattaatcctgtatgatgcgataatttttcctttggttgcccaaataagttttcaagcctatttgtcgtttttcgatatttaaatcgccatgcttttcataggtaaatagataatccatataacgtttaaaactatgataagcacttcttacattccgatgtttataaggataatagcccttttcattcggtttatctgaccattcttctaaaaatgctttatattttaaatgccaataatgtaatcgtaaatagacgtcttttttagaactctgtttaagtgtcaatgcaataattttttaattcttttcctgccatagactgatgctttcttcttaattttcgcatcactatcgctaccatataaaattgacacatttgtactggtgtattaaataaatctttcatcaagccacgtctaccatcacaggcaattgattgaatttggggctgtcctagataacgactaaaagctctattttagtcgttatctaggacagcccctattattttcctaatttcgcatcaagagataatttacctgcaccactatgccacaataataagaatgccatactaaataatgcagcagcttcgcctttgttactaattggatcgaaaatcgcccctgaagcagcgtggaatataaaataggctactgccatttgtcctgctagaataaatgctgttgcacgggtaaataaacctaaaatcaacaagataccgccaacaatctctaatacacctgctacaccaaacagagaaaagagtggtaccgcaccattgccgcctgtcattgaaatcggtaactcaaagaattttgcggtgccatgaagtaaaaacatataaccgactaatacacgagtgattaataggatatatggactgaaagtttgtgctaatttttcaaagaagttgttcattatgttttcctctaataaagtaaaaatatgttaatcgtcaaactgattaaattggatttgtcattatattgaaataaaacattagaaaaatagcattttatgaattatagtgtttcttattaagaaataaatggaaacaaatatggataaactcaccgctatcaaagtctttctgaccgttgccgaaacaggcagttttaccgccactgcagaacggttagagatttccaaaccgatgatcagtcgttatgttgctttaatggaggaatggctaaatgcccgactttttcagcgttccacccgtaaagtcgccctaacagatgcaggcgaacaagcggtgcttttttgccaaagaattgcaaacttaaccgcagagatggaacaagaaatgatggcacagcagggtgaattgcgtggtgcgttgcgtgtcaccagtagccaaactttcggggcgtatcatttagtgcaaatggtcaatcgctttttgcagttacacccgaagttgaatattcagctgttgcttaacgatcagacgatggatttaatcagcgagcggatcgatcttgccattcggattaccaacacgcccgacccgaattttatcgcccgaaaacttgctgattgccattcattgttggtggcaacgcctgaatatttgacaaagttcggtacgccaacgcagcctgaagatttgtatcaacatcactatttgtcgcaccataacatcaaccgcaaagcgtggaaatgtacgcaaggggaacaggaagtgttgctcgacctaaacagccgtttcaccaccaacgacacccaagccctgctcaactccgtgctggacagcaacggcattgcgatgttaccaaaatatatgctagaaccagaacttcaacagggcaaactgcaagccgttttaaccgactggcaactgccgacattcagcatttatgcaatgtatccttcgagggataaactaccgcttgctgtcagaaaattgattgattttttggtggagggttttgagggaaaagcgtggtaagcaaaaattaaaagccgcataaagcatgaactttaagcggcttttaatctatctataagaaattatagtgaagcttgatccacagctacaccagcacccatagtggtagagatgcttactttcttaataaagatacctttcgctgttgtcggtttagctttcactaatgccgctaataacgcttgaaggttctcttttaattgatctggagagaagtctgctttaccgattgtagtatggataataccatttttgtcgttacggtaacggatctgaccagatttagcatttttaactgcttctgctacgtttggagttactgtaccaactttcgggtttggcattaagccgcgtggacctaatacttgacctaattgacctacaacacgcattgcatctggagaagcgataacaacatcaaagttcatttcgcctttcttcacttgctctgcaagatcttccatacccactaagtctgcacccgctgcttttgctgcttctgcgtttgcaccttgagtaaatactgctacgcgagctgtacgacctgtaccgtgtggtaatactgttgcaccacgcacgttttggtctgatttacgagggtcgatacctaagtttaccgcaacatccacgctctcaacgaatttagctgtcgcgaattgttttaacactgcgattgcttcgttgatctcataagctttagtagaatctacaccagctttaattgctttcatttttttagtcaatttagccattgtattattcctctacgattaagcccattgaacgagctgtaccagcgattgatttcattttggtttcgatagtagcaccagtcatatctgctgctttagtttcagcgatttgacgtaattgtgcttgagttactgtacccactttatctttgtttggtttgcttgaaccagattttaagccaagtgcttttttcaataacactgcagctggtggagttttagttacgaaagtgaatgaacggtctgcgtaaactgtgataacaaccggaattggtaaacctttttctaagctctcagtacgagcgttgaatgctttacagaattccataatgttaacaccttgttgacctaatgctggaccaactggtggtgatgggttagccatacccgctgcaacttgcagtttaacgtaggcttggactttttttgccatttttaaagtttcctcttgtgtgggtaataacgccgaaaatggctccccttgtttttaataaatgaaagcactaaattaggtttatacagctaactaaaaagtgcacctccattattgaataaatttcattatttatcaagtaaatttatagtagactttgatttgtattgacatactatacccatgatgaaatggacttgttacttttatttcaatctggttatttaagtggccattgctcaaaaggtataccgataagaaatagcatttcagctaaaaacatacaggatggaatctaaaacactcgacgagattgggtatagcttttagcccaatatctctcggacatagaacttgtggttacaccttggcttgaacttgcgtgaacgaattttccattaccgatataaacaccaacgtgattatttttacggaaaaagactaaatcacctggacgtaattctgatttagagatggatttccccatatatcgctgttctgccgttgaacgtgggaagtgttggttaaaggcagaacccataatagcttgtacaaaagcagaacaatcaatacctgctttgctttcaccgcctaaacggtagcgagttccagcccattgacgatagacatccattactttctgtgtcacatcttgttttttggctgaggcaaattttgccgttgtttttgctttacttaattgcgttggggttgcaggtttggtactcaaacttgcgacagcgtttgaactatacccaacagacaacgcaatggtcagagaaaaaagaacggttttggttaaagaaaataatgatttttgcataataaatttgtctcgccagaactagaaaagcgaactacctcagctaaaaattaaagtaatttgtataaaacaaaggttttgttctgcacaaaacctatcacatcagaccagtataacttaattttgttccaaagaacgtagaaaatttatctcttcagcccaaatttcaggttcgattgtttctaaaatgagcggaatattgtcaaaatgaacattattcataataaatttaaagacatctgtcccaattgtgccttctcttaacgtgtgatggcgatctactcggcttgcaagcagtgttttggagccatttaagtgcatacctcgcaaaaattcaaaaccgaccactttatcgaaatcagcaaaagtttgttcacaagaggctaatgaactgatgtcgtaaccagccgaaaataagtggcaagtgtctaggcaaacgccaacacgctgtttattttcaacttgctcaatgatttcagctaaatgttcaaaccgccaccccaaatttgagccttgcccagccgtattttcaatcactgccaccacattaggcacactatcaactgcaatgttaatcgattcggcaatacgcgctaaacaatcctgttccgatattttatttagatgactacctgggtggaaatttaacaaggttagccctaattgatcgcaacgtcgcatttcatcaataaaggcttcgcgtgattttgccaaattttccgcttcgggattgcctaaattaatcaaatagctatcgtgaggaagaatttgtgctggcgaaaaatggtgaacttggcaaaaacgtttaaatttttcaatagtatccgcttttaagggcggtgcttgccattgacgttgatttttcgtaaacaaagcaaaggcattcgctccaatttcgactgagcgtaatacagcattttcaacaccaccagaagcactaacgtgagcaccaatatatttcatcttattttctccaaataattcgtgtaacataccgctttcattttacggaaactgattttatgaatcaaacaacaatcaacgacttttctctactatgccgtttattcggcaatctcttttatcgcagtccaacggatcctattttagcagggacttttgcgtggttaaaacagggtaatcttcgtcaaacttgggctttgacaaccgatgagcagagcgaagctgccctcacaaccgtagaaaaaaatgctaaccctacggaacaagcggacagttatcaagctctttttgcggaaaatggagctattgctacaacaatttctgcctatggattatccgttgccgactttgtagccttccgccaacaaagaggtatgcctgaattagccaatcccgatcacgttgcattactactgctaacagcctcttggattgaagataaccttaattctaccgaggctcaacgtgatttctttgaacattttgttttaccttgtttaagcaagttcttaggcaaagtagaagcctttgatactggtttttataaggcattagcccaacttactcgagatgcattaagtgcaatggcggatgagttggaagagttagagaatatttagttctgttggtactatcatgtagctgttagatggtacagaagctaacagctacatggaattaatttattcaaggaaggtcagtgcttgcttgacaacttctattttaaacgtgccgaccccttggcgttcaagctaccaagcataccaactattcaatgggtaggtatcaacagctacggctcttgggactgctccagccctcgtcaaattcctgtttggaaagataaaggacaacgctattgcacgggtggcggttctgtggttgaagcaaaaccaagtgtgtgggacgcattgtcactaggcaaagacacgcctcaaacccaaccaaataaagccgacgaagcagaagggcaagctccgattgagaaagtgtctccggttgaatagaagcggtgtttcactactctttggaagtacaaacaagctattctctcaaaactcgctaaataaaagtgttcataagcaagtataatttaccgttataccaaaacttatgaacactttacgacactattatttttcaaaatgagatactaattcccactatttaatgaataatttcacttaactcaacccgacgtttttcccttacagaaagcgtacaggcgtctgcggttgcaattgcagctcttgcggcttcacctgtgagtagttttataaactcttcatttggttgcataccgtgtaaaatatcattcagatatttcatctcttttttcataatagaacttagccacattggggtgcgttttcctggtttaccgtattggattgcaccgtccatttcagtactggtataaatacgcgttctatcatcatcttcttggctttcgtggaccaagaaataactctctttgccatcaaggcgtaatatgcctttgcaatgatacatatccagcttgattgcccctttggtgccttgaattagcacataatgttcgccccaacggaaggttgatccccattccaatacagcaaagcggttatcatcaaattccaaattgacaaataacatatcgtcttcatcaccaaactcaggggcgttgcgacaatgacacaatctacatcattacgcattactaattcttctaagctatttgcagcatcacatttcaattcttctgcgatggtttgtccgttctctgggtcgtaaaccgccgtaatttgtgcattatcaaattcattcataaagcacgcgagatctgcaccaaaatagcccacgccaacaacaccatatctaatcattttttgtctcctaaattaattaaaatacagaatttacctttaccgatagcgatgaaactttatttaactgagccttcagataatcctcctgcgattttattttgaataaaacaaaagaataatactgatggaatgactacaataaccgaagccgccatcatatcgccccaatctaggatctctgcaccatttagagatcgtaatgcaacggcaactgtcattttgctagtatcattgacgagaataagggcatataagaactcattccacgcattgataaaggtgtaaatggcagttgcaacaatacctggtgcaacaagcggtaatacaactttgaagaaaatagtgaatttccctgctccgtcaattttggcggcttcttcaatttcaatcggtaccgtctgggaaaatccgactagcaaccaaactgcataaggtacgctgaaggaaagatagacgatgatcagaccgcttgttgtattggttagccctgcttttgccattgcaatagagtatggaatagcaagcaaaatcggtgggaaaatataggttgtgaccaacagtcttgacattatcgagcctaatttcgggaagaaacgaacaataccgtatgctgccattgccgaaatggtgatagcgataatggtcgtaactagcgagataaataggctgtttttaatatttacaatgaaattgagatcgttaataacgtgttcaaagtaatctagtgtgaatatctttggtcaaaaccgagttggttcactggtgagttcccctttactttttacggacgaaatgaatatccataccaaaggaaagatagcaatgaccgttgaagtagctaagaaaagatgggaaacgatgtcgccaagtaatgaagatttctttttcattttatttactctccttttcccaacggttaataattttgaagtagatgaaacaaactgacagtaagaagataaagagcaatacagtcactgcagaagaacgccctaataatttacttccccaccccatatcataggcatagattggtaatgtcatcgttgcatcagcgggaccgccacctgtaataagataaataatatcgaagttattaaatacccagatggtacgcaatacgactagtaatccaacaacgactttaatatgcggtagggtgatataacggaacacttgccacatatttgctccatcaattttggctgcttcatattgatcggacggaatagtctgtaatgcggacagaatattgaccattattaaaggggcaccaaaccaaatgttgataaagactagacaaacgaatgcccaagtgcgatcagcgagaaaattaggggcaatatccatcagccctaactgcaccaacatattcggtaaatagtcataaacaccgtttaaaatccattgccaagaaaatgcgataacaatcatcgggaatgcccaaggtacaattaacaggattttataaagccatttaaaacgttccacccgatttaaagccaatgcaagtaagaaaccgactaacacctgacctatcagagataaggctgtccacattaatgaatgaccaaatgacatccaaaagcgaggatctgacaacaccgctttatagttggctaatcctacaaagctatatgtcggcataatcaagtttttattggtaaactataaaagatacttgagagaaacggatatacaaagagtaccgaaacgatcaacaacgcaggtcatacgaatatccatctagtatagttattgcgacggtaatacataaggaaagctccttatcaggagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaattaccgtcgaggccgcgttaaatgatgaactgaccgaccatcttggttatctaaaacgaaaattcagctttgcattgtgcatttagtgcgtaacagcttgaaattcgtttcgtggaaagattacaaagccgtcaccgcagatttaaagcaggtttatcaggccccgacggaagcacaagctcgcgaaaatctgaccgcactttcgcaaaaatggcaggcaaaatacccgcttgtggcgaaaggctgggaagataactgggcaaatattgccacattttttgattatccggctgatattcgtaaagcgatttataccacgaatgctgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcttagacgatcaccattaagttgaaatgggtgtttacacagaatttgggatagggtccgctcaaccaatcccttttttactaaccgcaacaacattctttttaccaccttataatagctatcacctacatcaacaaactgtggttgccccactaaccgtaatgcctgttctgcaatatccccacacatcaaccacgtcccctgattttcccttaatacctgtgcgattaaacgagtggtaatgacagactggcttttaggtattttcggcataaatggaattgccaactcgctaatctcttgcgttaaaagttgcatttgcaccgttaataaatcttgtttttctttcagttgaagtaaccgctcaactaactcgtgcttaagtaacttttgtgtcataataaaatccctattgagtgaaaattgcaatagggattttaatgttttcaatcggttaaatctttgtgcaactgctacataataccgtatagtacaaggctttaagccacttttttgaattatgaaccaaaaaaatgtcatttttgccacagtagcgacattcgcaaacatggtataagaaataatattcaacgctatgaatgtaatgcttgtaataaaacatttacccttaaaaagaaattaaatccaccactatcacgttatttaaatattattgcggataccaccttctttggtcgtgaatttggtgttttagtcctgatggattcgctttctaaaaaagtggtttaccatcgtgttattaaaacggaaaaagatgtttattacaggatagcatttaatttacttcgtatgaaaggctataacattcaatcaattacctgcgacggcaggcggggtatattgaaagatttattgaatacaccgacgcaaatgtgccattttcatatggtagcgattgtgatgagagcattacgaaaaaagcatcaatctatagctggaaaagaattaaaaacaatagcattaacgcttaaacagagttctaaaaaagacgtctatttacgattacatcattgatatttaaaacataaagcgtttttagaagaacgaccaggtaaaccgaatgaaaagggctattatccttataaacatagaaatgtaagaagtgcttatcatagttttaaacgttatatggattatctatttacctatgaaaagcatgacgatttaaatatcgaaaaaacgacaaatagacttgaaaacttatttgggcaaccaaaggaaaaattatcgcatcatgcaggattaacgaagcaacataagattatgtttataaaggattttttaaataaaaagagctgctaagaataattaaaaaggggctgacgcagattagctctaattttcacaccattttctcaacgttttaagttgctcttttggtgttccaaagtgaaaccgaaattcacattctttcaagaataaagggaaactttttcggtcaatcccattatattttcggagtatccgcttggcttgactccaaaaattttcaatgccgttgatgtgattttgtttcactgtaaacagctccgaatggctaattcgttcgtggtgaaattcgcttacatcaagggcatcataactatggtaagtatctgtataaacctagctgtcaggcttgattttccttgctataacaggcattggcgttgttgtcttcgtatcattgactaccacagtaaatacttttccttgccgtttcaatatccccaaaacagccacttttcctgccgcaccacgacctcgttttcctttacgatgtccaccaaaatagctttcatccaactcaatttgtccgtcaaatacttcatctgcttcaagggctaaatgataactgatgacctcgcggattttgcgataaaacaggattgctgaattgggctgaataccgagtaaatctgcggctgatcgagcagttacttctaacacaaaaaattcaagtagctttttctgtatagatttctttaatttacaatgagttatcttcatttttgtaggttagcatactagctaatctacgtcagccccattaaaaatattcattagcaaccattttgtctactatgtcattttatacatactaaggattacgcttaaacttgctaaagtcaggcgcacgtttttcattaaacgcattacgaccttcttgaccttcttccgtcatatagaacaacatcgttgcattacctgctaattcttggagacctgcttgtccgtcacagtctgcatttaacgccgcttttaagcaacgtaatgcaatcgggctgttgcgtaacatttcacggcaccaacgcaccgtttctttttccaaatctgcataaggcacaacggtattcactaagcctatctctaaagcttctttcgcatcatattgacggcataagaaccaaatctcacgtgcttttttctgcccaacgatacgtgccatatagcttgcaccccaaccgccatcgaatgaacctactttcgggcctgtttgaccgaagatcgcattttctgccgcaatggttaaatcacaaagcatatgtaaaacgtgaccgccaccaatggcataaccagcgaccattgccaccacaggcttcgggcagctacgaatatcacgttggaaatccaatacgtttaagtgatgtacaccactttcgtctttataaccgccgtaatcgccacgcactttttggtcgccaccggaacagaacgctttttcgccttgacccgttaaaacaatcacaccgattttttcatcaaaacgcgcatcagagaaagcttggatcatctcttttaccgtttgcggacggaaagcattacgcacttcagggcggttaatggtgattttagcgataccgtcagtcgatttatgatacagaatatccgtataaccttcgctgcaatcgagccactcaacaggggcataaagtacatcatcttttgggttttgcattttgtattccttttagtttaaataagtggataaattatactgggaatttatgaatttttccttgattatatactcagcctctcttctatgggaaatttgtatattaccaaatcttaatccgctcattaatcggacgatacattgcatcaccttgctttgtattaaaggcattgtggaagccagagatatttaatacaggggcaaaagcacggtattgtcctggggcgtgtggatcgcttttcacttggtgggttaaggcttggacggtcgctttatttcgccacgaacgtgtccagctcataaaaaagcgttgatctggggtaaagttttccaagattggggtcacaccgtgatctcgctcataacgttttaatgcatcatacgcaatacttaatccgcccagatccgcaatgttttcccctaaggtgaaacgtccattgacaaagatttttggggcaacttcaaatttatcaaattgagcaactagttgatcggcaagggcttcaaatttttgtcgatcttctgctgtccaccactcttttaagttgccatcaccatcaaattttgaaccgctatcatcaaaaccgtgagtgatttcgtgtccgataatagctccgatagctccaaaattaacggcaggatcggcgttcatatcgtaaagtggtgcttgtaagatcccagccgggaatacaatacggttcattaatgggctataagaggcattcactacctgtggcaacattccccattcattcaaatcaacaggtttgccgattttacttaaggcttcttggtaattccatttggcaatttcacgcaagttagcataaagcgaaccgccctgttctacggtttttaaatgcagttggctataatctttccatttgtttggataaccaacttcaacgatgaatttatctagcttcactttcgcctttgctttggtttctgccgacatccaacttaaattgtcgatacgctgatggtaggctttaaccaaataaccagccatttcaagcaggtcttttttagctgtcgcagggaagaatttttccacataaaattgagcaaattcctgcccaatttggttgttaatcaaacgtaacgcacgtttatctaacggtctttgctgtttctgtcccaccaactgcttgccataaaaagcaaaattcgcatcatctaaggctttgtttaaataggtagacgcatttgaaatggttttaaagcgtaggtaatctttaattaacgcaagattttgtgggttgatgagctgatcaaactgttttaagaaattcggctcccacacaatgacttcttccgtattcaccccaacggctttgagataatttgcaagattaatatgtttactcgctttagctaattcattgatagataaaggattatagcgtttttgaatatctcgacgttgctcattggtaaatagggttttcgcaatcgctttttcatactccacaatcgcttttgctttttgcttcggattttttacctgagcaaaatgaagcatctgtgcaacataatcttgataaagctgtaatgttttacgattttcaggggtatccttttgataataatcgttgctcaaaccaagactatcattactgaaatagattgcgttttggcgagagtttttcaggtgagcaaataccgaccaaccaaatagcatctcattgccttgcttggtttcattaattaaatattgctctaactctgcaaaggtttttatcctctcaattcggcttaaatcagcttgaattggacttaaaccgagcttttcacgggcagtcaaatcggtataactttgataaagtgcttttaaacgttgtgccttttcatcattcgcaaaatttgggtttgaaatcaccgcttgtaacagctcaacagaacgtttttcattcaattcattgagttctgctaaggttccccaagaagtacgatcagacgggatttgggtggtatctacccacttaccattcacataacgataaaagtcttgctgtggagaaacactgttatccaccccttcggttaaggtgctttggtaggttttcgtggtacaagccgttaagcctaaagcaagggcaataaggctaaaagagagcgtttttttcattttatctcctaaaaataagcggtaagatttggctctagaccttcttaccgcttatcagttcaattgctttagttattctgtacatacttccgctaagtagtaataagattaaggttatcttttataaattatgcggatttcgagtatttgcatcaaccaaattacgcattaacaaagcataatctaattccacatcggctggtacatctaaaaagacaaaatgcccatcgcctaaaccagcttcaatagcttcatttttgcggtttaacattcgttcgattttgaacacgatattgcctttcggggtcatcatttcaacttcatcgccaagtaagaatttatttttcactgcgacttccgccataccttctgtattgcgtttgccggtaaattcgccgacaaactgctgacgttctgaaatcgaatagccgtaatcgtaattttggtattcatcgtgggtatggcgacgtaagaaaccttccgtataaccacggtgtgccaaggattctaacgtatccattaaactttcatcaaaaggcttgcctgctgccgcatcatcaatcgctttacggtaaacttgagcagttcttgcacaatagtagaatgacttagttcgaccttcaatttttaaggaatgtacgccgatttgggtcagtttctcaacgtgttgcaccgcacgcaaatctttcgagttcataatgtaagtgccgtgttcatcttcaaaagcggtcatttgctcatccggtttttgcgattcggcaagcaggaaaactttgctagtggtatcgccttcgcctaaggttggtgcgacatttttaatttcaatctgctgttctggatcaatttttgacacgatattgccaacatcatctaccttaccttcttccacctgatattcccagcgacaagcgttggtacaagtgccttggtttggatcacgtttgttgatatagccagataataagcaacgtcctgaatatgccatacataatgccccgtggacaaaaatttcaatttccatatcaggcacttgctcacggatttctgcgatttcatcaatggaaagttcacgagaaagaatgacacgggttaatcccatctgtttccagaattttaccgttgcccagtttactgcgttggcttgcacggaaagatgaatatccatttcagggaaatgttcacgcaccaacataatcaagcctggatcagacataatcaacgcatcgggcttcatatctacaacaacttgcagatctttaataaaggttttgagtttggaattatgcggggcgatattgactaccacatagaattttttgccaagtgcgtgagcttcatcaataccgattttcaaattagcgtggttaaattcgttattgcgaacacgcaagctgtaacgtggttgccctgcgtaaacggcatctgctccataagcaaaagcataacgcatatttttcagcgtgcctgctggtgataaaagttctggtttatgttgtaacatgtggattctctttctgataacaagtcaggactttcccgaaggaaaacgtaaaaaggcgttattctaacggaataacgcctttgggttaagaattatatgtttgtttagtgaaaattctgccattacaagcagtcggtttcgactcaaaatttgcaaattttagagcctaactgaccgcttgtatttaggaggcaaacaggttagatgcccgctttattaagcaaaaactggctcaacaacggcactggtctgcctgttgccccttttgcagcccctgatttccacgcagtgcctgcaatatctaaatgcgcccaagtgtatttcttggtgaagttagataggaatacccctgcggtgatcgctccgcctaaacgtccgccgatattggcaagatcggcaaagttggatttaagctgttcttgatactcttcgcccattggtaaacgccatgctttatcatctgcttgttctgcagcatttaataagtcgtttgcaagtgcgttatttggtgaaatcaatccgctattgtggttgcctagtgcgatcatacacgcccctgtgagtgttgccacatcaatcactaattcaggatcgaaacgttcgacataggttaaggtgtcacataataccaaacgtccttctgcatcggtattgaggacttcaacggttaagcctgacattgtggttagaatatcaccagggcgataagcgttgccgtctggcatattttcacagcctgcgagtacgccgataacatttaatggcaatttcatttccgcaatggctttcattgtgccatagacagaagccgcaccgcccatatcatatttcatttcgtccattgcatcggacggcttaatggaaatgccacctgtgtcaaaagttaagcctttgccgacaagaacaatcggttttgctgcaggatttggcgatcctttatattcgataattgaaagataagcatcattttcagaaccacgagaaacggcaagataggcgttcatttgtaatgccgccatctctttttcgtccagtaccgtggtagtgatgttatcgtactctttggctaagccttttgctaattcggataaatatttcgggttgcaaacatttggcggacagttcgctacatttttggcgaagatcacgcctgatgcaatcgctttgccgtgttcaaccgcttgttctgccacagttaaatctttgcggttagcgatattaaatacgattttgcgtaattcacggcggatttcaggtttcacgctcttaaattcgttatattggtagccgttttcttgaatggcctcaatcgcaaagcggatattccagtaaacggaacgggctttgacgtgtaattcggttaagaagcagatcgcttccgttgagcctgtgtcgttaatgacttgtaccattttttgaatggtttgtttgtattggcgttcagtcagttcacgctctttgccgcagccaactaacaacacgcgatctgcggggacattgggtacgttgtgtagtaataacgtttgcccaacacatccttctaaatcgcctttacgcaataaattgcttaaatagccgtcacttaatttatctaattgctccgcagcaggcgataagcgacggggttcatacaccccaacaaccagacagcctgtacgttgtttttcaacagatccgtttttaacgctaaattccataaaatactcccgtgattttttttgtataaaagggtatgattacacattttgcaagcggtgggttttggtaaaattttacaatattatttagcctttgtttgaatgataaagaaaggtagggacacactgcgtgtgtccatatttctggctcaaacatatatttgcggacatatatagttttatggacacgcagctttacggacacacgcagtgtgtccctacaagtgggctattcaaaattttacccaaatccaaccgcttgaacttgcaattaaaatatgggtcataaaactacctgtttgcttgaaaattgcaagcgataaattgtcaaaatgagaactttgtcgtgattttaagtcgatatttaacgaaagaaatatttaaaagccaaattgctatacttttcatactgttagtgatcttcttctgccaacaattagtacgagtattaagctcggctgtgagtggcaaagtccctacagacttagtattgagcttgctcggattaggtatgccgacaatggcacagttgatgttacctttgtcgttatttattgctcttttactcactttagggcgtttttatgctgaaagtgaaattacggtaatgcgcgcttgtggggtggggcagagccttttagtgaaagcagcgttatttttatcgatctttaccacggcagtggcggtttataatgtcttttggcttaccccttgggcgattaataaacagagcgaaatgttggctgaagcaaaagcaaatcctcgctttgctgcattagccgcagggcaatttatgtctgcaggtgggtatgtgttatttattgataacattaaagataacaccattaatgatatttatgtttttcagcctgaacagcaaaagaaaaataaaccctctgtggtggtggctaaatcgggggaattacaagggcttccgaatggcgatcaaatgttaaatttaaccaatagtactcgttatgaaggaacgcctcaaacggcggatttccgtatttcgcattttgataattacaatgcctatctcggctatcaagatgttgatagtgatgaaaaattggttcaacgtgccgattttcagaagttgcttgctgaaacttccccagaagctcaggcagagttgcagtggcgtttagcgttgattttatctgtgccattgatggcgttgctggctgtgccgatgagtagtgtaaacccacggcaagggcgttttgcaaaattattacctgcgttattgttgtatttaatctatttcttattacagagttcgttaaaatcggcaggggcttcgggtaagctaaatgtgtctttgttaatgccaatggtgtctgtggcatttttagtgcttggcactcttttaaatagctgggaaagtaaatggttttcggcattgcgttatcgtttttcaagtaaaaaggtggcaagtaaatgaatgtattagagcgttatatcggcagaaccattcttgcttccattatgcttaccctatttatgttagtagggcttggggcaattattaaatttgtcgaagagttccgttccgttggtcgagggagctacgatggcttacacgcagcatattacaccctattgacgatgcctcgtgatattgaaacctttttcccaatcgcagcgttgcttggttcattaatggggctgggcggtttggcgagccgtagtgagttagtggtaatgcaatcggctggattttctcgcttccgcattgggctggcggtgatgaaaacggcaattccattaatggtgattacgatgattatgggggaatggggcgtaccgcaaacggaacaatatgcccgaaatatgcgatctattgctcaaagtggcggttcaatgctggcgacccaaggcggattttgggcgaaagatggcaatgattttatctatattcgtcaaattcaagatgaacgtaacttaaataatattttaatttaccaatttgaaaatcaggttttaaaatccatcaaacaggcggaaaaagcgacctattcggaacaaggctggcttttacagcaggtggataaatcagaaattcacgaaagcggaataacccagaccagagaaacagatcaggcgtggaaaacaagcattacgccgagcaagttagggatcgtgtccttgaagccagagtcgttgtctatttcgggattagcggattatgtaggctttttaaaagatacagggcaagatccaaaacgttttgagattacgttctggcgtaaagtttttcagccgatctcaatggcggtgatgatgttgcttgcgatttcctttatttttggtccgctacgcagtagtacgatgggggcaaaaattgtgatcggtattctcgcaggctttgtattttatgtggcgaatatcgtctttggtaatttaagtcttattgtttcgtggctacccgtaccaataggggcattaatcccaagtttgctctgtttaagtgtggtgtggtggttgttgaataagaaaagggattaaattaaggaaatactatgttaaaaaaattagtattaaagaatttcacggtatttaacgaagttgatttaaatttttctccccatttaaatgttattattggggaaaatggaatgggaaaatcacacattttaaaattagcgtattctctcattgcttgtaatgcttctgctttttctgtaagtaaaacgcaaatgcaaaagaattatgcagataaattaattaatgtatttagacctgaaagtttaggccgacttgttcgccgtaaacaagggagagagcgttgtgaaatttcagctaaatttgaaaatgacttttataattgtcaatttagttttgcgacatcaagtaaatccgaagttcaaatagatatattacctaaaagtaaaatagagaataatcctgtttttttacctacaagagaattattaacgatttatcctaattttgttcatacttataataatcattatttagagtatgaggaaacatattatgacacttgtttattattaggaaattatttagccaaaggtcctagagaggagagtgcaaaagagctattaaaaccattagaagaggcaatgggggggaaaacggttttagataatggtcgtttttatctttctattcagggacaaggaactatggaaattcctttggttgctgagggattaagaaaattagcgatgattgcgagattaattgcaacaggatctttgttaggtaaaggtgcgttattttgggatgaaccagaggcaaatttaaatcctaaacttattaaaacagtcgctaaggttattttgcagttatgtaataacggtatccaaatttttattgcaactcattcactttttttattaagagaactagaaatactttctaaacgacaagaatttgctcatttaaaacaattttatttcggtttaaaaacgatagataatggtattgcagttgatcaaggtgatagtattaatcaattggaagttttaacattattagacgaagagcttgaacaatccgatagatttttagcattggtagaataaatgtcagagattgtaattaaagaaggtgatttaacgtttatttttaacgagtttattcttgttgaaaaatatgatgatttatctttttatcgtaatcaatttaatgcttttgcaaatggaaccaaagcagtagatattattgtggttgatgaaaatgataactggatgattgaagtaaaagattatcgacaatatcagagaacgaaaacaataccattagccgatgaaatagcaattaaagttagagataccttggctggaattgttgcgatgaaattaaatgcgaataatcaaagcgaacagcagtttgctaaacagtttttgaagaaaaataagataaagatagtattacatttagagcaaaaaagaagtaattcacgtttattccctcagccgatcgatcctgcaaaattaaaacaaaaattaaagatgttattgaaggcagtcgatgctcatccgtttgtggtgaataaagatagcttacattcgacaatgcattggaaagtcatttaatataaatagaaaataaccattatgtcccaacctcgttttgttcatctgaaagtacacagtgatttctcaatgattaatggcttggcgaaagtgaagccgttaatcaaagcctgtgttgccaacaatatggtcgcaatggcattgaccgattttactaacttctgtggcttggtgcgtttttacggcgaagccttaggatcgggagtgaagccgattgttggggcagatgtgatggttcgccctgaacctgagagtgaagagttatacgaacttacccttttagccaaaaataataccggttatcataacattacccttttactttcaaaggcttatcaacagggctatgtggaatttcctgtggtggaaaaagcgtggctggcagaacataatgaaggcgtgattttgctttcgggcggtagcaatggcgatgtaggtaaggcattattgaaagaaaatcagcaagaagccgaacagcttttggctttttatcaacgttatttccacaatcattattatctttccctttgtcgaacaggaagaagtgatgaagaacgttatattcaacaagcggtcactttttcgcaaaaatttgcaattccgttggtggctgtcaatgatgtgatgtttttaaaacaggacgattttgaagcccacgaaatccgtgttgccattcacgacagctttacgttggacgatcctaaacgcccacaaaaatattcggaacagcaatacttccgttcagaagacgaaatgtgtcagttgtttgccgatttgccacaagcgattgaaaataccttattcattgctcaacgttgtaatgtcaccattcgtttaggggaatatttcttaccgaatttcccgacgggcgatctttccactgaagattttttagtcaaaaaagccaaagaaggtttggaaaagcgtctggtatttttgtttcctgatcctgaagtgcgggcaagcaagcggtctgtttatgatgaaagattgcaagtcgagttggacgtgatcaaccaaatgggctttcccggctactttttaattgtgatggaatttattcagtggtcgaaagataacgatattcctgttggaccagggcgtggttctggagcaggatctttggttgcttatgcgttgaaaattaccgatctagatccccttgaatttgacttactctttgaacgtttcttaaatccggaacgggtttcgatgcccgattttgatgtggatttctgtatggacgggcgagatcgtgtgattgaacacgtgtcggaaacctatggttgccaagcggtgtcgcagattattacctttggtactatggcggcaaaagcggttattcgagatgtagggcgtgtgcttggacacccttatagttttgtggatcgtatttctaaattgatcccccctgaccctggtatgacgttggcaaaagcctttgaagccgagcccaaattgcctgagctttatgatactgatgaagaagtgaaagccttgattgatatggctcgtaagctcgaaggggtaacacgtaatgcaggtaaacacgcagggggcgtggtgattgccccaacggcgattaccgatttttcaccactttacttcgactcttacggtttacaccctgtgacccacttcgataaaaatgatgtggaatatgcaggcttggttaaatttgactttttgggcttacgcacgctgacgatcatcaaatgggcgttagagatgatcaatcaacgcttggaaaaagaaggtaagccactggttcggattgaaactattccccttgacgatgaaaaaacctttaaattattaaaagcagccaaaaccacggcggtattccagctagagtcacggggtatgaaagatctgatttcacgcctacaaccaagtaactttgaagatattattgcgttggtagccttattccgtccaggtccgcttgagtcgggaatggtgcagaactttattgaccgtaaacacggcaaagagccgattgcctatcctgatgcccagtatcagcacgagtcgctgcagccgattttagagccaacctatggcattatcgtttatcaagagcaagtcatgcagattgcacaggtgttggctggctatacgctcggtggtgcggatttattgcgtcgtgcgatgggtaagaaaaagcccgaagagatggcggctcaacgggcaacctttgaagaaggggcgaagaagcagggaattgatggcgagttggcgatgaaaatcttcgacttggtagaaaaattcgcaggctacggctttaataaatcgcactcggcggcttatgcgttggtatcctatcaaaccttgtggctcaaaacccattacccagcggagtttatggcggcggtgatgacttcagagatggataacaccgataaaatcgtcggcttttatgatgaatgtatcaatatgggattaaccgttgttccgcctgatattaatagtggtaaacaccgttttagtgtcaatgaaaaaggcgaaattgtctatggtttaggggcaatcaaaggcgtaggcgaaggcccgattgatgcgatgttagaagctcgcaataaagacgggattttcaaagatctattcgatctgaccgctcgtgttgatttaagaaaagttaatcgtcgcacatttgaaggattaattatggctggggctttcgataaactagggcctcaccgtgcggcgttgatgaaaaatttagaagatgcccttagagcgtccgatcaacataataaaatggaagcacttggacagagtgatatgtttggcgtgctgactgaaacccccgaagaagttcagaacgcctatgccaacacgccaaaatggacggagcagaccattttagataacgaaaaagccaccttaggtttatatctaagtggacaccctgttggacgttttttgaaagagttagctcattatgcaccgaataaattaaatgaagttcaaccaacctatcgaggacaaactactaccgttgctggattaattatgggggcaagaattgcgacaaccaaaaagggtagtcgtattgggattgcaacgattgaagatcgttcaggtaaaatggatctcacccttttttcagaagcactcgaaaactatggcgatctgttgcaaaaagatcagattattatcgcaacaggggctgtgcaacacgatgatttcagtggtggcttaaaaatggcggttcgcgaaatgattactcttgatgaagctcgtagccgttatgcaagaagtttagctctagcgatcaaacaagaacagctctcagcaaaatttatcaaagatctgaccgctattattgagccttataaagagggaacattaccgttacatttctattatcaaagcccagaagggcgtgtattattgcgtagtggcgttgagtggcgtgttaccccaaaagagacgatgctgcagaaattaaaagattttttaggcgaaaatgccgttgagttggagtttgagtaggagtaaataatgctacgtataatttatactattctaggttatttagtactacctattatttctcttatcatatggcagaaagaacattctctacctaagcgtcgtaaatgtttgaaggaacgatacggtttttattcatcgggtgaaatcaagcctcaagcaaatggcattgttattcacgccgcttctgtgggagaagtgattgcagctactcctttgattaaagcgattttagcgaattatcctcagttgtctgttacggtgacgacagtaaccccaacggggtcagatcgtgttaaagcagcatttggcgatagtgttcatcatctttatttaccctatgatttacccgatgcggtgaaacgttttttagactttgttgaaccaaaattattgattgtgattgaaacggaactttggccgaatttaattcatcaaacccatcaacgccaaattccctttgtgattgccaatgctcgcctttcgcctcgttcagcaaaacgttatggttggattaagccttgtttgcaagagatgttgagtgaaattgattttattttggctcaagatcaggtgagtgcagatcgttatttggggctaggatttaaggctgaacatttggttaatactggcaatcttaagtttgatttagaagtttcacctcaattacgagagaaggttgctcaaaccgccgttgaactacatttacttgaccgtccgatttgggttgcaggtagcactcacgaaggtgaggaaaagatgttgttggaagcacatcagcagttattaaagcaatctcctgatttagttctgatccttgttcctcgccaccctgagcggtttgatagtgtggaaaatttactaaaaaatatgggaatgtcctatgtaacacgctcttcttttgaacttttaagtgcaggaacatcggtactgttaggcaatacaatgggagagatgatgctgttttatggcttggctcaggtcgctttcgttggtggaagtttagtcaaacacggtgggcataatccgttagagccaattgcatttgaacttcccgtgatttctggtgtacatacttttaatttccctgagatttttgctaaattaagagaggttcggggcgtgattgaaattcaaagtgatgtcacttcgattgttgatgccgtcaattacttttttgaaaagcctgaacttggacaaaaaattagtcaagcaggggtgagtgtattacaagaaaatcaaggtgctttaactcgtcatcttcaactgttagccccttatttagagaaatagaatgaaccaaactgtaatttatgctggcacatttgatccgataacaaatgggcatttagatattattcaacgcagtagccgattgtttggcaaagtgattgtggctgtggcaaaaaatccctcaaagcaaccgctatttagccttgagcagcgtgttgagttggtacagcaaagctgtcaaatgctgaataatgttgaggtcatcggctttagtgggttgttggtcgattttgctaaacagcataatgccaccacgcttattcgaggtattcgaggggcggacgacattgagtatgaaattcaactggcacagttaaatcaaaaattagcagggcagttagaaacgatttttttacccccagccgtagagtggcgttatctttcttcgacaatggtaagagaaatttatcgccatcagggagatgtggggcagtttgtgccagaaatagttttaaagtctctaaggtaatcgatgaggaaagtgtgtttacatatgatcaagattttaaagagggtagtgtcaatgtagtttagtgaatgaataatgagatacgtaaaacaagcagataccagatattcgcatgaatttttagtttacagcctaaaaatttaagggtaaaattgcaaaattgctattccatatggatagtaaatgatggtgctgagccttatctcaagccccatccaagaccgtaggtgaacctgtgtgaacagtttcttaatgaaaacaacctacgtagatggtgaacagacagaattatctgcttctgtacaccttagcctcaaaaacgtcgctcaagcggttacttttttgagattttttgtaaattccacagtatttatgtggagtgtatcaggagctaaaaccaatggcattaaatcttcaagacaaacaagcaattgttgctgaagtaaacgaagctgccaaaggtgccctttctgctgttgttgcggattctcgtggcgtaacagtagagaaaatgactgagttacgtaaagcagctcgtgaagcaggcgtttcaatgcgtgttgttcgtaatactttattacgtcgtgcggttgaaggtactgaatttgagtgcttaaaagatacgtttactggtccaactcttattgcattctctaacgaacacccaggtgcagcagcacgtttgttcaaagattttgcaaaagcaaacaaagagtttgaagttaaaggtgcagcctttgaaggtaaaatccaagatgttgaattcttggcaacattaccaacttacgaagaagcaattgcacgtttaatgggcacaatgaaagaagctgcggcaggcaaacttgttcgcactcttgcggcattacgcgacaaattacaagaagcggcataatttttattcgccgtattctcaactcgtttaacttatttactttaggaattgattgttatgtcattaactaacgaacaaatcattgaagcgattgcttctaaatcagtatcagaaatcgttgaattaatcacagcgatggaagaaaaatttggtgtatcagcagcggcagcagcagtagcagtagcagcaggcccagcagaagcagctgaagagaaaactgaattcgatgttatccttgcagatgcaggtgctaacaaggtagcagtaatcaaagcagtacgtggtgcaacaggcttaggcttgaaagaagctaaagacttagttgaatctgctccagcagcattaaaagaaggcatctctaaaggtgaagctgaagcacttaagaaagaattagaagaagctggtgcgaaagtagaaatcaaataatttttgatttagcttttaaattgctaattctatactcaataaaacccgataacaaatatcgttatcgggtttttcttctataatgacagctatgaatactattgaaattgtttttgctccaaatgatgaatttatcccttcagattttttaaattatttggggaatataaacaaatctcttgataagccgtcagcttatcaaataaaaaaatggaaaagtcgccgtatggcttatttcctgttacatcaattatttgaaaaatatcatttagataaaagtttattaattaatatcgttaaaacagaaagtgggcgcccttatattgaacatagcgagattgattttaatattagccattcgggcgattgggttgcgattattttctcttatcaatccccgaaaaaagtggtgggtattgatattgaacacccacaaaaaatacgtcgttttaacgatttattacattattatgccagtgagcaagaaatagctgaaataaataatcatcatctattctcggaactctcttcccttgaaagtcgtttttacttaagttggtgtttgcgagaagctgtgcttaaatcacagggttctggaattataaaactgtcggaagtaacccactcattaagtaaacagcagatcacaaccgcctatagcccaacaggaaaactctgcttttatcatcaacttccattttatttggcttatttttttgaacatactcaggctatgttatcattaccaaaactgagccaatggaaaaatggggactacatctcatttgatcatcttcacccaattatttatcaagtaaattaaggatagtatgaataaatttaatttagaagaacaacattctcgtttcgggaaatttatttctgagagttttcaatggatattaaatctttcactcttagtgatagggctaattttagcttactctcttttttatgaagcatactcattaattgaattattttttagccatagtgaaaaattccaaattgtagaaaaaattgtgattttctttttatattttgaatttctagctctcattgttcaatattttaaatataactaccattttccattacgctattttttatatatcggcattaccgcaatggtacgtttaattatcgtagatcactctaatgcaatgcacacgttattatttgcattagctattttagtgatgatcgttgctttatatattgttcattcaaaacgcttacataaaagctaaggaatttttatgacacaaattcagcaatttcagcaaaaagatttagagatcttaaaagaagaagtggtttatcaaggtcacttcacaatgaaaaaaatgtatttccgccacaagttatttaatggtggagtaagcggtgaaattgtgcgtgaattaatgattaaaggctcggcagccgcattaattgcctatgatcctgtcaaagacgccgtagtgttagtcgaacaagtccgcattggtgcttacgatccaacaagcaaccaatccccttggttagtggaactgattgcaggaatggtagatgaaggggaaacgccagaagatgttgctatccgtgaaagttacgaagaagcaggtttaaccgttagcaatgtggaacacgccttaagcatttgggacagcccaggcggtgcggttgagcgtttacatctctttttaggcttagtcgatagcacccaagtcggcggtgtttacggtttagaggaagaaggcgaagatattctcgtccacgttgtgagccgtgagcaagcgtatcagtgggttgttgaaggcaaaattgataatgtgattgctgttgttggattacagtggttacagttgaattatcaaaggtataaagagccacatagcctttcagtacaactgtaatttgatttctaaccgtatggatacaataaatattcaaagggtatagtagacaaagtggctgctaatgaatatttttcattaaagagtgcagataatatagtaaattaaaccgtaaaaagtgatatagcccaccaataatcctatctttgctactagcggttgcttttgatgtaatttatgcagcaagccagcaatagccaataaaatgaaaggataaatccaaaatgcggtagaaaaccaatcaatttgacttgggctaaggttaggattttcgcttaatgcaggtgatacaagcaatgctaatggccataatgaactgggcaaacaaaaaaatgccaatgcccaactaaattttgaaaaaccttgttgcatattatcctcttgggtgaaactgttgatgcagtgattttaaacgagttttcgccacttgggtataaatttgtgtcgtagacagatcactatgtccaagtaacatctgcacaacccgtaaatctgcaccgtgattaactaaatgtgttgcaaacgcgtggcgtaaaacgtgtggagagagtttattactatcaatacccgccaacaacgcataatgcttaattcgatgccaaaaagtttgacgggtcatttgattgcctaaacggctaggaaaaaccacatctgactgcataccattaagcagtgaacttcgcccatactcaaaaaactgttggatccaataactcgcttcttctcctaaaggcactaaacgctctttatcacctttaccaatgatacgaactaacccttgacgcaggcttaagttatccagtgttagagaaacgagttctgtgacacgtaaacctgtggcataaagtagttctaacattgctttatcacgcaattctaaaggatcctgagtatttggaatattcagtaaatccagtacctgctcttcactcaatgatttaggtaaatgggctggtttacgcggagatgtaagtgttgctgttggatcatcatctcgatacttttccaaataaaggaaacgaaaaaacttgcgcaaacagctcaacatacgagatgaactcgttgctttatagccttgctccagtctttcgcccaaaaaggtttgtagatcaacatagtctacttttaaaaatgcattgggttcagaaagccattgggtaaaactttctaaatctagtctataagaggctacagtattttctgataatccctgctcttgccatagagtatcaagaaattgttcaataataggatcaagtggtttcataataacgataaaattatcgtaaaaatctgcaaaattctaacataaaaataccttggaaggtcgactgaaatgaaaaaaccgattagcaaaactaatcggtttatttgaaacatggcaggggcggagaggctcgaactcccaacacccggttttggagaccggtgctctaccaattgaactacgcccctatataattatttacatatagttaaagcgagtaatttactcgcttataaataagtggcggaacggacgggactcgaacccgcgcccccctgcgtgacaggcaggtattctaaccagctgaactaccgctccgcaaattgggtacttggcaatgccctactctcacatggggaatccccacactaccatcggcgtaactgcgtttcacttctgagttcggtatggagtcaggtgggaccacagcactattgttgccaagaaattcttttattaagttagttcactaatttaatgaactaagttaataaaaccccgacgatgctctactctcacatggggaatccccacactaccatcgacgttacagcttttcacttctgagttcggtatggaatcaggtgggacaactgcactattgtcgtcgggaaaatcttttgatgattctctctatcttcttttttctgttctttaagggcaaatgtaatttgcccctacactattctaatttcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtcttcaacaacccttactagcttatagctagggagaactcatcttaaggcgagtttcgtgcttagatgctttcagcacttatctcttccgcatttagctacccagcaatgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtaatcttcgttagaacatcaaacgttaaagggtggtatttcaaggacgactccacaagcactggcgtgcctgcttcttagtctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcttacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttccggcgaacgagtttttcactcgttttatcgttacttatgtcagcattcgcacttgtgatatctccagcatacttctcaatacaccttcatcgacttacacaacgctcccctacccaacagacgtatcacaaatattcctctgatttctatccgcactttatgccaactcaacgtgttgggtgcttgaccaacatcttattccgtttcacttcattcgatgttgttaatcgtaaggcgtatttgtgatacgcctgatgccgcagcttcggtgctatattttagccccgttacatcttccgcgcaggccgactcgactagtgagctattacgctttctttaaatggtggctgcttctaagccaacatcctagctgtctaagccttcccacttcgtttcccacttaatatagactttgggaccttagctggcggtctgggttgtttccctctccacgatggacgttagcacccactgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacaaaaacttaaaatacggggctatcaccctgtgtcgcttggcttcccagccaattcttctgtctttgctgctatcacttgctggctctttcgctttcgctcgccgctactgacaaaatctcggttgatttcttttcctcggggtacttagatgtttcagttctcccggtttgcctcaacagactatgtattcatctattgatagtagattcttcatctactgggtttccccattcggatatcttggattaaacgcttcttatcaactcatccaagcttttcgcagattagcacgtccttcttcgcctctgattgcctaggcatccaccgtgtacgcttagtcacttaaccatacaacctcaaacattttcacttgaagttgatattaactactaaacacttgactgcttttgttcagtcaagatttttcttactactcagactttcttgtttcagggcaaatgtgatttgcccctacagaaaatctctcagttttcagcttgtttccaaatttttaaagaacattcgataatcacttatctttcgacaaaaaatcatctttaaatggcgtccccacggggattcgaaccccggttaccgccgtgaaagggcgatgtcctaggcctctagacgatggggacaacatttaaagatgctttccttcatcctgtcaatttgcaaattttatcgcaaatctgaccgcttgtgtctgttttcttgctctattccttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcgccctctgtatgcaccattgtagcacgtgtgtagccctactcgtaagggccatgatgacttgacgtcatccccaccttcctccagtttatcactggcagtctcctttgagttcccgaccaaatcgctggcaacaaaggataagggttgcgctcgttgcgggacttaacccaacatttcacaacacgagctgacgacagccatgcagcacctgtctctaagttcccgaaggcacactctcatctctgaaagcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagccacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgctctattaaaacatcacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaggtggcccgaaagtcccaccctctagtccttagacattacgcggtattagcgacagtttcccatcgttatccccctccataagccagatccccaagcattactcacccgtccgccactcgtcagcaaagaaagcaagcttccttcctgctaccgttcgacttgcatgtgttaagcctgccgccagcgttcaatctgagccatgatcaaactcttcaatttaaaaagtttaatcgctcaataaactgcttagctaaagtttacatattacttttaagtaaaaatgaatttctagtttaagcacctattaagacttcaaaattaaaaaaatatatttaaacaaagtcaatcaacaagtgcccacacagattgtctgataaattattaaagagcaaaataaagtggtcggcgagataggatttgaacctacgacccactggtcccaaaccagttgcgctaccaagctgcgctactcgccgtctgatatgccactgcatatatttaatggggtggctaatgggactcgaacccacgacaactggaatcacaatccagggctctaccaactgagctatagccaccatttctagtcgatattgcattacctctggcgcgctcgacaggatttgaacctgcgacctttggctccggaggccaacgctctatccaactgagctacgaacgcgttgttttcagtactgcgtcgcaacggaggcgtatattagtgatttcactctcgcttgtctagcacttttttaaaaaattttcttgtatgctcttaatttattcaaaatgtctagagcgtgttgatcttttaagtacaaaaaaacaaacgacatagaaatttggtataatttagttcgccaaaacctaaccattccatacaaactaagcggtcaaaatccgcaagcgattggcaaaagtgtggcgggtaatagcacaaaaattcatttagcggtagatagttgtggaaatcctattgattttgttctgacgggggtgaagttcacgacagtaaagctgcgcctgagcttgtggaattgttacctgacagtgagaccattgttgcagacagaggttatgattgtgaagccttccgagcacttattttgacgacaacaaaagcagttccggttatacctcgtagacgaaattcaaaggtgggtaatgaggatatagactggtgtttatatcgttatcgccatttagttgaaaatgcgtttgcttttttaaaacaataccgagccattgcgactcggtacgataagttagcaagaaattatgcggcatcgctagcaatgatttgttgtattcgctgggggaaattgttgtttggttaagatttaaactcaaaagatcaacagcccctaaggctttaattgtattggtttcatcgcctacgtcttttatacgtttcagcacgtcaaatagaggagcggtacaacaagaaaataaatcggctaaggcttcatagcttaatgaacggttattattcacttcaagtagcatttgctcaaaagcggtgcaagcccctttcattcgttcaagtgcaacaaaatcatcttcactaattaaaaaatgatggtcatattgaaaataagtatttaaaaaagcattggtttctacaataaaacgttgttggtttatcgctggccgtagctcgtttacggctgatttattcattttgcgtaattcgcccaaggcttctaagcaacgcttgataattggtgtccagcagtctgttgttttatctataaagctaatggcggtttcaatggaaagccaaaaatcaagcgtttcattccgtgctttattttgaataatcaaataatcttgttcagcctgaaagcctaatttagttaaatgttgttggctttctttggtggttggatgccagctaaaagcaacgtgtgcaagctcttttaatgaaataaaagattgttggcgattattgataagttttgtttgaagagaaaaggggaactgttgagcgttcataatgaactcctttgtgtatttacgaaattttaccctataaaatagggtgccaaggggttcgtaagccacacaaagacggctggagttatttccctttcgggtgttgtattcctcgccccctcggtattgagtttaaataaattgtgccttttgccccaaaattgcaaattttaggtacaaaaaaccgcttgatctatcgggtgcggttatccgctttgtgtaaggttacgacaccttgagaacagtcatacgcgttttaagataaatagcaagtgtttaattaaaaaattgaatgttcaactttaaaatcattgttgtttactcataactatttgatttttataaaatagaatttctttcattaagttgaaccattcaaatcttttcttgcaagcggtcaaatttcccctaaattttaccaatccccacaaaaacgcccttttaagccctttttctgtttaagccgaacaagtgtagctcttttgtcttttagtgtgtttataaacgctcgtaaacgccttaaatttgattcttgcttgttgtatttggcattagttatgtattgcagtataagtgttttattaaagtagtttaaaagagcagttttataaatcagtttaaagtttgcggtattggttgaatgattaaaacagagcgatatatgaacaatgctgaagttgcttacaataatttaatcgaaactttagacagttgtattgaacaagcttacgaaaaggcacaaggtgataaagcaaagtttaggtttcattttttagaattatttgggaaatttaatggaggtttaaatttgtatattcctaaatttgataaccttacaaaagaagcgggcaaaatcccacagtttgggcgtttagcttttcgcactcgttcaaccgttcgagaattacacggcgactctaaccgcttaacgcctgaagatgtaacaagtttaagcgtagaattaaaagaacacgatattgaataccctattgattatcgtgaagataatgatgccagctatcctttgaaaaaatacgctctttctgttgttcaagatgtcattgcgttagggcgtgaagtggctgttgctgaaattgcacaaaatgcagagaattattcagctgaaaatgttgttacactgactgaaacacaacgtttcacaaatgcaaaatctgaccctttaaaattcatcaatgatggtttagaagctgtttctgctactattgggcgtttgcctaatgtttgtgtaattgcttcagatgtttggaaaattttaaaagaaaatacaaaccttttagaacgtatcaaatacactcgcacaggcattttaacccctgaaatttttgctgaattgattggcgttgaaacggtaaaaatcggtgcagcttctcaagaaaaagatggcaatttagaaaaaatctggtcaaatagcattgttttggcttatgttgcaaacggtaaagataaaggcaaaaaaggcaatatttttgaaccgtcttacggttacacggtaagacgtaaagacggcttatttgttgatacttaccaagagaaaggcggtaaagtggaaattattcgttgcacggatattaacgcccctttccttgttggaaaatcagcaggttatttaattcaaggttgtattaagtaaataggttttacctttcaatcagattgtttgcttgcaccgtcaaaaaacggttttctgattgattgaaaacgttactaaagacgtaaaaaagactaaaagggctttagctagtggaatagttaaagcccttttctctaaaaaatgaaattttattgctgtatgtgaaaaaagcgaaattgttatttatcttgctttttttgttgtagttatgtcgctttgttttaataaaattcgatgactttttgtttgaaagattgggtgtatttagtcataaaaacctgcaccttaattagttggttgtttagcccaacttttggggtgcagatcatctacgtcagcccctaattcaatttaatcttgcaagttatgataatgcgctactgctcttgctttgcgaacgtaagggctagttgtagaataccaaagcctcatattaattaaaccaaacacaaaaagcccactatttccatagcaggcttttttatcactaaaaattagtcaccaacagcaatgcgtttcatatctgtcatataaccacgcaattcttggccgattaactcaaccgggtggttgcggatggcatcgttaatatcacgcaaatatacattgtcgatttcaacggttggtgttggttcgcctaaatcgcctttttgtaacattgggattaatttctctgcaagaattggcgttgcaacgtgtgagaataagtagttaccgtattccgcagtgtctgaaataaccacgttcatttcgtataaacgtttacgcgcgatagtgtttgcgattaacggaagctcgtgtagtgactcatagtatgcagactcttcatagataccgcttgcaaccattgcatcgaatgacatttcaacaccggctttcaccattgcaaccatcactacgccgttatcgaagtattcttgttcagaaattttgataccgtctgcttttggtgaattttcgaaagctgttttgcctgtttcttcacgccattttaataagtttgcatcgccgtttgcccagtctgccatcattgttgatgagaactcaccgctgatgatgtcgtccatatgttttaagtaaagatcgtttaattggagtttaatttcttccgctaattcaaaggcacggatttttgctgagttagaaagacgatccatcattaatgtgataccgccttgttttaacgcttcagtaatggtttcccaaccgtattgaattaatttgcttgcatatgccagatctttaccgtctgccactaatttgtcgtagcacacgatagaacctgcttgtaacataccgcaaaggatggtttgctcacccattaagtcagatttcacttctgccacgaatgaagattctaacacgcccgcacggtcgccacctgtcgcacttgcccacgcttttgcaatcgccataccttcgcctttcgggtcgttttcagggtgaacagcgattaatgtcggcacaccgaaaccacgtttatattcttcacgcacttctgtacccgggcattttggtgctgtcatcaccacagtgatgtctttacgaatttgctcgccttgttcaacaatgttgaaaccgtgtgaataaccaaatgctgcgccttgtttcattaatggcataacatctgcaaccacttttgagtgttgtttatctggggttaagttaatcactaaatctgcagttgggattaactcttggtatgtgccaactttaaaaccattttctgttgcacgtgtgaatgaagcacgtttttctgcaatcgcttctgcacgtaatgcgtaagcaatatctaaaccagaatcacgcatatttaaaccttggtttaaaccttgcgcaccacaacctacgatcacgatttttttgccttttaagaagttgcaaccgtcagcaaattcgctacgatccataaaacgacaacgacctaattggtcaagtttttcacgtaagtttaatgtgttgaaatagttagccataataaaaatcctgtgttgttaatgttgaatgtttgatgttgtgtttacatactgtagttgtttttgcgagtttgattatagctgtttttgttattgcgtaaattgacattattagaatttatcattgcactaaataaaatcacaagcggtcagaaccctattattttttgcaaatttttgcggagtaagagccttaacactcaagttatctttgctataattccccaaatttacctaaaattgaaggaattcttatgtcccaacttatcgaactcactcataaactcaaagaaatcttccaaatcaaccgtgcagatttggattttgggatttatcggattttaaacacccgtagccaagagattgaaaagtatctttcacaaaccttgccacaaaaagtgaagcaggcgttgggcgataaccaaagtgagcaaatcgctggttggcaggcggaactggagcaagccaaaaaacaagcccaagagctaggcattgacccaaaccaatcacccaaagtccaagaactgcaaagcaaaattgaacaagccaaaaaaggcagtgctgatcacgagacggcggtttatcgccatcttttaacctttttcagtcgctattacgaagagggcgattttatcagccaacgccgttataaaggcgatacttatgccgtgccttattcaggcgaagaagtgttgctacattgggcgaataaagatcagtactacaccaaatcgggcgagaatttcagcaattatcgttttagccttaatgatggtcgcaccgtctttttccgtttaaacagtgccgatattgccaaagataaccgcaaagataacgatgcgaagcgtttgtttacccttgccactgcacaaaccattgaacgtgaaaacgaagatggcgagttggaaatgattgacatcaacccaatcacacaaagcgaagacggcaacaccttaaccattttgtttgattacaaaccgtttgaaaaattggcaaaacaagagaaaattttggaacaagatttagccacgttgcaagctcacgatttgctacaaaccaagtggattgccttagccgagcgttgcccaaccgaaaaaaatcctaaccgcactttattggaaaaacatttaagcgactacacccagaaaaacagtgccgactattttatccataaagatttaggcggttttttacgccgtgaattggatttttatatcaaaaacgaagtgatgaatttggacgatgtgcaaaatattagccatttcgcaccgcttgaagcgaatttacgcctaatccaaaccttacgcagcattgctttggagcttattgcctttttggcacagttggaaaatttccagaaaaaattgtggctgaaaaagaaatttgtggcagggcatcactatttaattacccttaaccatattttgcagctcgaacaagcgggcagatttattgaagaaattgcaaataacagcaaacagcttgcacaatggcaaagcttatttaacctgccgtctgcagatgctcaagcatttttaaatactcaaaaagcaaacaatgcggggggggtaaaccctgtttaaattcaaatagttataatgatttacaacatcttgttgtagatacatcactcttttctgccacattccaatccgcactgatttccgaactttcacgctcactgggcgactttgatagccatatcaacggcacgcttattcattcggataatttccaagccttaaatttattacaagcccgttatcgtgaacaggtgaaatgtatttatattgatccgccatataatactggcgaagatggttttatttataaagataattttcaaagttctagctggctaacgcttatggaaaatcgtgttatgttagcaagaagtttgcttgcaaaacaagctgcattattttgtcaaattagtgatactgaaaacacaaacttaaacaaattgatggtttcagtttttggtaaagaaaatcacagagaaactatttccgttattacatcaagtaaaagtggagtaaatgctattaatgtaaaacgtggagaacgtttatttaaaatcaaagaatatttacatttttattcaaatcatccgagttttaggtttaactccttctatacagctgatgattataatgtaaattataaatgggaaatatatcaacaagatgatggttcatggtttgtttgtgatttaaaagctactagaaaatttgatgaaaaatcactctctgaatatgcattgaaaaatccaaaaaatatttattctattgaaaaaaacaatagtaaagcaggcgaagctatgaaatttattttggagaaaagtaaggcaagtggaacagtagaaacttttactgatcagtttggtgtaactaaactgatttatcaaggtggtgtatgtgttcctttagaagaacgtgtaattcaagagaatggaaaaaatgtatttggagtattaggttctgatatttgggatgatattgggcaggccgcaaaatcagaaggtggagtttcatttgataatggtaaaaaaccagaaaaactcttaaagcgagttattgaaatggcaacgcaagaaaatgatttagtcttagactatttttcaggtagtgggacaacagcttgtgtatcacaaaagctaaacagaaagtggattgcgattgaacaaggtgaatattttgaaagtgtattaaaagtacgtattcaaaaaactttatttggcgaacaaactggaatatcaaaatcaatagactataaaggtggtggaattgttaaagtactgaaactggaaagttatgaagatacgctgaataaccttgaacttcgccgcagtggcttgtttgacaatctttcagacgatgtacaacaagactatttgctccactatatgcttaatttagaaagtcgtggcagtttgcttaatgtatcgcattttgagaaaccctttgattatggcttgaacattagcaccaccagcgccggtgcttatgaatggcaaaaagtggatttggtggaaacctttaattatctgattggagcacggttagtcagtattgatgatcagcgagttaaaagaggctatgtagcgatagattgtcaattacctaatcaaagcggggatgacaaaacattaattgtttggcgtgattgtgaacaatggcattatgaaaatttgtatgcagaaaaagaattcagccacaattttcaaggtaacaaaacgacgctatttggtaagataaattttaatcctaaaaataccgactatgcacaagtctatatcaatggcgaccatacccttgaaaccgtgtgggacggcgagcaaagtggtagtttgaagattgtcagcattgaagatgcgtttttatccttgatgtttgagggggatgcataatggcaaaagcaccccaaaataccaaattccattttgatgagcatttaattttaaatcgttggctgttttcgttatttcacaaaacatcgttaaatgagtttaaaagcctgttggaaagcgtagaaaatgacgaccatatcgccagcgatggacagagccatttttatcatcgcctaagcaatgagctgttttttgaacacgataatccgctaagccttgcggagcttgctgcttatgatttgcggttggtgcattattggcaaaaaattacggaaaagcgtaatcgcacaagcggtcatattttgcgaccaaaatacttccagtatctatcgttactgtttaccgaaatttatttggattggtatttcaacaaaaaagccgaattacagaccgcacttaatcagcagttagtgcaatacgccaaagagatgggcaaaaatgcacaagattttgaagtgtatcgcttaaatgatttaaacaaaatcgcgttttggaatgctacaggttcgggcaaaaccttgttgatgcatgtcaatattttgcagtatttgcattatttcggcaaaaaccaaccgcttgtacgccccgataaagtgattgtgcttaccccaaacgaaggtttaagcggtcagcataaagaagagcttgaattgtcaggctttcaagccagtttttttgataaaaatgttatctcgcagacggcatttaattttagcgtagatgaagtgggcattggcaagtgcgttgaaatcattgatgtcaataaacttgccgacaaatcaggcgataaaaccgtgtcggtagaagcctttgaaggcaataatttggtgttggtggacgaagggcatcgtggcatatcgggcgaacagtggctgttacgccgtgaagccttagtcaaaggcggttttgcctttgaatattcggcaacgcttgggcaagcggtggcaggccgcaaaaccattgctaaacaagtggaagacaagcaaaaagcaaaagccaagttattgtttaataaaggttcgttaaaaggtttatcagaagacgacttagccaaattaacccttgatgagctggaaatggcaaaggttcgcaccactgcagtgcttgaaacttatgctaaatcggtgttgtttgattattcctataagcatttttatcacgatggctatggtaaagagagcctgattttaaatattgaaaaacaaggttttgatgagcatttgcctgtttattttgtggcaggtttgttgtcgttttatcaacaactttatttgtttgaacagcacaaaaccgcattggcggaatggaatattgaaaagccgttgatggtgtttgtgggaaataaagtggcggacgataacagcgatattctcacggtggtgcgacaactggcgttttttgtgaatgaaccgcaaacagtgcaaaaatggctgaaagaactcatactagacaatcctcaaatattgggtgagagcaataaacatgtctttaaaggacgttttgtgccgttgctctcttttgtcgatgatgtagctacattgtaccaagatatgttgcgtaagatttttggggcgacacattcaagccgtctgcgtttaacccatttgaaaaaaagcgatggtgaactggcattatcccttggcgaacaaggcgagaaatttggtgttatcaatatcggtgatgcttccggtttgctgaaaaccgcacaagaaaattttgccgatgagtttgatgcggtgagcgatgagtttaatggcggtttgtttgctgaaatcaatcataaaacatctcccgtaaatatcttaatcggttcacgtaagtttaccgaaggttggtcaagctggcgtgtttctacgatgggcttgctcaatatgggcaaaggcgaaggtagccagattattcagttatttgggcgtggtgtgcgattgaaagggcgtgaatggtcgctcaagcgttcattgccaagcgttcgtccgaaaggtgtctttttagaaaaactggaaacgctgaatatttttggtatcaacgctgattatatggaggtgttccgtggctatttggatgatgaagatatccaaaccggcgatgaaatgctgacgttggatttccctgtgcaaaaacgcttgcctgccatcaaactgaaaaccttaaaactcaaagaagaagtcaaaggcaatcgtaagcagtcgtttaagcgagtaaaaaagaatatttatctatttgaaattcctgaagaatggcagaacaaaattaaagggattgaaattagcctagatcgctatccaaaagtacaaagttttgccaccaaaggcacggcaatcgctcaagtgcaaggcgaacagcgtgatgaagtgaagttaaattcggcactgtttgacttttttgattgggataagatttatctgcaagtggcacgttttaaacatcagcaatcttggtataacttgcgattagataaagcgaagttacgccaatttgccgagcaaagtcattggtataggttgtatatgccaaaagcggcgttaaagatggatagttttgctcaagtggctttacagcaagagattttgacggatttgttgctggaatatgtgaaagccttttataaccgcttaaaagccgcctacgaagggcagttttatgaagtggttacggtggatgacagcaatggctctatgttggataaataccaatttagtttgcctgataatgacgaaggtaatgaaatcaaacaacgattagaagccttagcagacggcattagcgagtttagcaatggggtaaaacctgtttatggtggcgacaagggtttgcaaatgctctgttttgatggacatttgtatgcacccatttttgcttgcttagaacgccaagatttgccgtttagtattcaaccgcttgccattggcgatgaaagtgaactgcgtttaatcagtgatttagtcaatgccaaagcaagtggcaagttgagcgagtggacacaaggcaaagatttgtatctattacgcaatgctgccaataagtccaaaggcttgggttttgctttggcgggcaatttctatcccgactttttgctgtggcttgtggacaatcaaacaggtaaacaatggcttagcttgattgatccgaaaggcattcgcaatatggatttagacaatgccaaatttgggttatacgatgagttgcaaaaattagctcgtgaattgaagattgagaccccgattttatctgcctttattttgtccattaccaaacaggcagatttgctcaatgtggggcatttaacaacacaagatttcgccgagaaacatattttatttatggacggcaatcaggtttatctcaaacagatgtttaagatgatgctgcaatagtggtgtatatacttgaaatggtaaagtaggaataacgtacacaagaaaagtggattttgtgtgcatatcggaataacatacacaagaaatcccattttcttgtgtatgttgtgtgaatgtacacgttattcctaatttttatgttgatgagaacgaagtatgaattacgtcattcctgatttattcgcgttgggagatttggaaagcaaatctgtttttaaagcctgtacccacgcacatcgtgcattgggggagttaaaaggtgtcgtgcatacgatgccaaatcccaatattttgcttggtactttgcctttgcaagaagcaaaagaaagttcagaaattgagaatattgtaaccacacaagatgacttatatcagagtaattacgccacacagcaatttgcttctggggcagctaaagaagttcattattatgttcaggcaatgagtttaggatttcatgaagtacaaaagagtggtttgataaccctaaatttaattaaagagatacagcgtgagttggaaggtaataacgcaggcttccgcaaacaagcaggaactggtttagtgaatcaaaccacgcaagaagtggtgtatatgtcacctcaaacctatgatgaaatcgaaaatctgatggctggtttagaaaggtttatcaacgattctgaacaaatggattatgaccctttggttaaaatggcattaattcatcatcaatttgaaagtattcatcctttttacgatggaaatggtcgtacagggagaattatcaatattttgtatttgattcagcaaggattgttagatacgcctgttttgtatttatcacgatacattaatcgcaacaaaggtgaatattatcaattgttacaagcagtacgagaaacccaacaatgggaaccttggctgatttttatgcttaatggtattgctgaaacggctattcaatcggttaaattgattaatgaaatcaaagctctaatgatgaagcaaaaacagatgattcgtgaaaatttacctaaagtgtatagtcatgaattattaaataatttattcaaatatccctatacaaaaattgactttgtaatggaagattgtcaaatccatcgtaatacagccgttaagcgtcttgacgaattggttgctttaggtgttttagcgaaaaccaaaataggaaaagaaaatttttatattaatgttgaattgtttcatttgttgatgcagtaggtaattggaaaatttgtatgaatatcacagcgtatcaagcgaagtattttgccaatgaaattttgtgtcgttccgaaaatggagtggctcgtatttcagacggtttatttaatgctaaagtagatcttaatccccatcagattgatgcagcgttatttgcactgaaaaatccgcttgggcgtggcgtattgcttgccgatgaagtgggtttgggcaaaacggtggaagctggtttggtgctttgccaattatgggcggaacgaaaacgccgtttgttggtaatctgccctgcggtgttgcggaaacagtgggcaaatgaattggctgaaaagtttggtttaccttgtgtgattttggataaatcgctattaaaacaagaatatcaaggcagcttgccaagttttttgcaagccaacatgggcaagagagtcataattatttcttaccaatatgcaaccaaattcgcgaattttttggccggagaactgtttgattgcgtcgtgatggatgaggcgcataaactgcgtaatgcccatcgtaccagtaataaaatggggcaaacattacgctcggcatttgatgggcgtaaaaagttactactcactgcaacaccattgcaaaatagtttgatggaactttatggtttatctaccttgcttgacgaatatttatttggtgatgaaaaggtgtttcgccgtgagtttgtcaatgagcacaatatggcggaattaaaaagccgtctgcaaactgtggtaaagcgaacgttacgcaaagatgtgttggaatatatccgctataccaaacgccatacgcttacccaaaatttctatccaagcgatgaagaacaggctttatatcaagctgtatcggattttatcagcaaagaacatagcttggcgttaccgaagcgacaacgtcatttgattggcttgattttgcgtaaattattggcttccagcccttatgccgtggcggatacgcttagcattatcttaaaacgcctttatacactcaaagaacaacaggctaaacaagaatatttattacttgatttgagagagagtgaagcagacttagccgatgagttggatgaagagtgggaagatgatgagtcaaatgatgatgaaggattaacatcggatgatcgtcaaacactagatgatgaaatcgctcaaattgaaggttttatcgcacaaaccaaacaattacgccacgatagtaaagcaagttcacttttaaccgcactacaaaccggttttgccaaaatggcggaacttggtgcagctcaaaaagcgattatttttacagaaagtgtgcgaacgcaagcctatttatatgactttttgattgccaatggctatgccaatcaagtggtgagtttttcaggtgctaatcatcacactgatgccaaacgcgtttatgaacagtggcttgctgatgaaaataatgccggtcgaataacaggttctccacaagtggatatgcgtacggcgttgattgatcactttaagaacaatgcacagattatgattgccactgaagcagcagccgaaggggtaaacttgcaattctgttccttgcttatcaattacgatttgccttggaacccgcaacgagtggaacaacgcattggtcgttgccatcgttatgggcaaaaatttgatgtggtggtgattaactttttgaaccaacgcaatgaagccgatcaacgagttttagaactgttaagcgaaaaatttaagttatttgatggcgtattcggtgcatctgatgaaattctagggcgtattgaaacaggtttggattttgaaaaacgtattgctcatatttacgatagttgccgcagtgcggaagaaatcaaacaagcctttgatgatttacaaaaagaaatggaaacacaaatccaagaggcaatgcagacggcaagttcggctttgttagaccattttgatgaagatgtgcacgaacgcttgaagttacagctttcccaaagccaacaattattggataaaaccagccgctatttttggtatgcaagccaatttgcattacaagattatgcgcaatttgatgaagcccaaaaatccttttacttgcaacaatcgcctattgaaacagctcaaacgggacgctatcaattgcaacaacgagaggggcagacaggatacgattatcgcttaaaccatcctttaggcgaatggtgtttagagtattgtcagcaagttcaaaccgatgtggcttgtgtacagtttgattatagccggcacccaacgaaattatctgtgttggcggaacatcaaggacaatcaggttggctatgggtggataagctcggtttttatggagaaaaccaaacacaggaacagcttgtttttaccgccagaaccgatacaggtgaatggttagatgaggatttttgccgaaaattgtttagcgtatcggctcagataaacgcagataatgttgctttacccgatgacttgcaaagcaatgccaatcaagctattcagggcataagtgcaaaacaggctgaaacacaaatggcgttattaaaacaagaaagcgaacgtttggataaatgggcagaagataaaatcaaggctgctcaggaagccattgtggaagtgagtgaaaaaatcaaacaagtcaaacgtgagaaaaaccaagcagcaaatttagaacaacttgcaaattttgaaacacaattgaaagatttagagaaaaaacgccgacaattaagggcaaatatttttgatgtggaagaggaaattgaggaagagcgagataggttatttgctcgtatccgagataaattagaacaacagcgtaaggttgaacatttgtttgcggtaaggtgggtaattacttgattactacaagcggtcagaaccctattattttttgcaaatttttgtgagaatctcaccgcttgctttgctgattggcaatgaatccgttataatcttgccaatttttcacccttatttaatagaaggaaaccaaaatgggcttagaaaatgtacctgctggtaaagagttaccagatgatatttatgttgtaattgaaattcctgcaaattcagatccaatcaaatatgaagtggataaagaaagtggtgcaattttcgtggatcgttttatggcaacagcaatgttctatcctgcgaactacggttatgtaaaccataccctttcttctgatggcgatcctgtggacgtattagttccaacgccatacccacttcaaccaggttcagtgattcgttgccgtccagttggcgtgttaaaaatgactgacgaagcaggtggcgatgcgaaagtagttgcagttccacacagcaaattaaccaaagagtacgatcacattaaagatgtaggcgacttaccagcattattaaaagcacaaatccaacacttcttcgaaagctacaaagcattagaagcaggcaaatgggtgaaagttgaaggttggggcgatgtgaatgaagctcgtcaagagatcttagagtctttcgaacgtgcgaaaaaataattaaactattaaccgaatataatgccaaagtaaacgctttggcattttttatgataggaattaagtatgaaatttttcaagaatcttagcgttatagcaatttgttcactacttttaaccgcttgtgttagcacagcccaaattaatcaagaagcagaaagtaattatgctaaagtgaagcaggaagcaagagcaaaaagtatgttagatactagctcaacgacagctcatcgcattcattcggttttcaataagatgaagctttatgcggaacgagcaaataaaacaggagtgccgtttcaatgggaaatcattgtgctgaaattaagtgaattgaatgcttgggcgatgcctggtggaaaaatggcattctacacagggctggtggataagttgaatttatctgatgacgagattgcggttgtgatgggacatgaaatggctcacgctttgcaagaacatggcaaatcagatcgtactgttagcacagtgacaggtattgttggtgtacttgctgatgttgcagtgaccgcaacaacaggcgtgaatacagaaggcttgctcagtgcaggggtggatttagttgccaataaacccttctctcgtagtcaagaaacagaagccgatgaagtcggtttgatgttaatggcagagtcaggttataaccccgaagcagcaccaaatgtgtgggtgaaaatgagccaagcgaatggtagttcaggtttgtctattttttctactcacccgtcaaacgaagatcgccaagcgaatttagcacgtttagtgcctaaggctaaggaaatttataatcggaaaaaataatacctaaataacctgaaaaattctatgagccccactataaatagcggggaactcacaaaataatattctatttatggaaaacagaatatattttttcccctaattattaggattcactatttagtaaaggttaccgaggtctgctcaggcaaatgtaaatctaactgattatacggaatagaaatcccagccttatcaaagccaatttttactttttccaaaatcgcaaattgtgtagttgaatagttattcgtctgtacccacggacgcacaaataactgcacactgcttgccgctaagttaccgactgcaatggtaggctctggatagtgtaaaacattttcatcttcaaacagaatttgagcaataatctctttagctttctcaatatcggactcatagctaatatcgaaaatgaagtcgatgcgacgagtttcattgcgggagtagttggtgatactgtcggcaaatactttaccgtttgggatcaacaccgttttattatcgaccgttcttagctctaacatcaaaatccccatttgctcaactttacctgatttaccaccagcttcaataaaatcgcctttgttaaatggtttaaagattaatagtattaccccagcagcaaagttttgtaatgagttttgcaaggctaaaccaatggctaaaccagccgcacctatcaatgccactaacgaactcgtattaatgcctaattgtgaaagtgaggcaatcactgtaatcagcaaaaacagaaaataagcgatagatcgaacaaaaccttgtagcatttcatctttgcttgatgctaataccgctttgccgataagggtactgatagcccttgccaaataacgcccgataacaaaaatcgcaattgcaattaacaatttagtaccatagggaataatccaattttccaggagttgttgaagttcaagattttttacatcagtaataatctctttcgcttcagggggtaaagtgatttcaggtatgatttcttttgttttttctgtggtactcattatgttctcctatatcaatttcagcctattctaacacgagacagaatttgtgataaaatccaattcatttttcctttctttatatcaaaatgacaacagaaaaagtaattagtgccagcgttcaattttttacgatcagtgatgatgaagctgggcaacgtttggataactttttactcgccaagctcaaaggcgtgccaaaaagcctgatttaccgtattgtgcgtaaaggcgaagtgagagtaaacaaagggcggattaaacccgaatataagttgcaagcggacgatattgtgcgagttccgcctgtgcgtgtggcagaaaaaaatgaagcaccgatttcgaccaaactcaacaaagttgcagagcttgaacatcaaattctttatgaagatgaagtgatgttagtgattaacaaaccgtcaggcattgccgtccacggtggtagcggtttgagcttcggtgtgattgaagccttacgagcgttacgcccacaagcccgttttttagagctagttcaccgtatcgaccgagatacatcggggctgttgttagtagcgaaaaaacgttccgcattgcgtagtttgcacgaacagttgcgtgaaaaagtggtacagaaagattatctcgcgctcgtgcgtgggcagtggcaatcgcacgttaaagtgattaaagcaccactattgaaaaacgaattagccagtggtgaacgtattgtacgagtaaatgaagaaggcaaaccgtccgagacccgatttgtaattgaagaacgttatccgatagcgaccttagtcaaggcttcgcctgtgacaggtagaacgcaccaaattcgtgtacatactcaatacgcaggacacccaattgcccttgatgataaatacggcgaccgtgaatttgaccaaaaaatgcaacaagcgggtttaaaccgtttatttttacacgcccattctattcgatttgttcaccctaaaacgggcgaagaaatggtcgtgacagcaccgttggataaacaactaaaagccgtgttggcgaagttgagggtaaaataatctaatcaacctcactactacatccatagatagtgaggtctattaaaaaatttatagtctaacccgtttttatttaccttttttcaaaaactctaccccagtatcagggaagtcagtgaatacgcctgttgcaccagctttgttgagtagggcatcatacatttcatcaatgttggtgaagaactcaggtagtgcgtctttgcgtactgtgtacgggtgaagttccatcttatattgggctaactctttaactaatggggtataaacaatattgccctttttagattgtttgtcgtcaatgagcatataccaacctggcccaacgccgtctgcgtatttcgctacttctgccatcgcacctggtttaaacatccagtcgtagttgtaatttacccatttacctgatttgtctttttcttccgtttcgtgccagtcagtgtaagccactaattgtacaagttttacgtccataccaagttttggtaacaattcggttttgatacgttttaactcgttgaagtcaaaggtttgtagataaacaaggtctgatttttggtcataaccgtattttttcaacacttttaaagtttccagtgcaatatctttaccttcttggtggtgtaaccaaggggctttgatttcagggtagatgccgatttttttacctgtggatttttctaaaccttggataaattcaatttcgtcttcaaaggtgtgaattttgaaatcagatttccacattgggaagcggtttggatagacttgaacttgtttaccatcttctactttgaagttttcggtcattgcaagatcttactctaaataatccgcttgttgtccaaatgcgagagctttactttctaaggtatgttctggtaaataaccactagcaccacggtgtgcgataatcagtttatctgactgtgttgcaactgaggttgatgttgagcaacctgctaatactgctgttgcgactaaacctaatgcaaattttgtgagtttcatactgttttcctctttttgtagatataaaaaaggaagaccaaaatgtcttccttttaatcattaattatttaccatagctatcttctaatttcgctttatgtttgccttcttcaagcattgtgatgaacattaacaatactgctaatacgccacctgcgatcattacatagaagccaccgtcccagccgtagtactctgctgcccaaccaaccactgctgatgcagagtggagcaagatatgcggtaaatgatcgtgagtctgcaacggagtgcattgaagaaaataaaatcttacgtcggattgctcgtcactgtattgatgaaacggaagggttgtttattactttgcctgaagatgagctcgcctatcaaaaaacctttattcaagcctgtacggagtcaggcattgaagcggtggctatcgatccaaaacttgcgatgcaaatggagccctcggtaaatccagcccttgtcggtgcagtggttgtgcctgatggttccattgatccatttcgcctcacagcatcaaatatgttagatgccacagagaatggtgcgaaagtctttacctattgcgaagtgaaagggttaattcgtgaaggtggtaaagtgattggcgtgaacgtttacgaccataaaaacagagtggaacgtcaattctttgcccctgtggttgtgaatgctggcggtatttggggacaaggcattgctgagtatgccgatttgaaaatcagaatgttccctgccaaaggcgcattgctggtgatgggacaccgtatcaacaaaatggtgatcaaccgttgccgtaagcctgccgatgcggatattcttgttccaggcgacactatcagcgttatcggaacaacatcaagccgtattccttacgatcaaatcgacaatatgatcgtcacccctgaagaagtcgatattctctttagagaaggcgaaaaacttgcaccaagtttaagacatacccgtgtattgcgtgcttacgctggggttcgcccgttagtggctaccgatgatgatccatcaggacgtaatgtcagccgtggtatcgtcttgctcgatcaccaagagcgtgatggcttagaaggctttattactattacaggcggtaagttaatgacctatcgcttaatggctgagtgggcaacggatctcgtttgcaaaaaattaaacaaaaccgaccgctgtgtgactgcagaaaaagccttaccgggttcaagtgaaagccgagcagaaaccaacagcaaagtcatttcactaccaagtaccattcgctattctgcagtttatcgtcatggctctcgtgctactcgcctgttggataaagaacgtcttgaccgctctctggtttgtgagtgtgaggcggtcaccacaggggaagttcgctatgcagtggacgagttaagtgtcaataatcttgtcgatctacgtcgccgtacccgcgttggtatgggaacctgccaagcagaactctgtgcctgccgtgccgctgggctgatgacccgttttgaagtggcaacaccacggcaatccaccactcaactggcttcttttatggaagaacgctggcgtgggattgagccgattgcgtggggcgatgccattcgagaagccgattttaccagttggatctattacagtttattaggtctaaatgatgtgcaaccgcttgcagagcaagctcaacacgggacagatagcaatgaattttgatgtagtcattatcggtggcggtcttgcaggcttaacctgtggggttgccctacaagaacagggtaaacgttgtgtgattatcaacaatggtcaagcagcgattgatttctcatcgggttcaatggatttactcagccgtttgccaagcggtgagtttgtcgctgatttttacaaatcctatgcaactttcgcaaaacagttgccacaacacccttacagcttacttggcaaagagaaagtccttgccaaagcgacacaatttgaacaactcgccacatcgctcaagctcgatttggtcggctctaccgcacaaaatcacctacgagtaacgcctttaggtggcttgcgtggagcgtggttatcgccaaacagtgtgccaacagtcaaaggtagcgagcctttcccctataaaacaattgcgatattggggatcgaaggctatcacgacttccagccacaactgttagccgataacctaaaacagaacccacaatttacccactgcgaattaagcactggctatctcaatattccagagcttgaccaactgcgtaacaatgcccgtgagttccgtagtgtgaatatcgctcaagtgttagaacacaaattggctttccgtgatcttgtggcagaaatcaaaacggcaaccaaaggggcagaagcgatcttcttaccagcttgttttggcttggacgatcaaagtttcttcaaccagttacaacaagcggtggaagcaacgatttttgaattaccaaccttaccgccatcattgctcggtattcgccaacataaacaacttcgccaccgttttgaacgcttgggcggtttgatgttaagcggcgacagagcattaaaagccgatattgaaaatggcaaagtacaacggatttatacccagcttcaccaagacaatgggatcagtgcagaacattttgtactcgccacaggaagctatttcagcaacggcttaaaagcagactttgatcgcatttttgaaccagtattccaagccgatattgttggttgcaaagatttcaatgaaaccgaccgcttgtcgtggacggctaatcgcttttcatcgccacagccgtatcaatcggcaggggtagcgatcaacgaaaaatgccaacttcgcaaagatgggcaatttatggcgaatttatatgcagctggcaacgtcattggcggttttaacagccttgaattaggctgtggctcaggtgtggcagtggtaacggcacttgccgttgcagaagaaattgtgggggcataatatgaacaacattcaacgtttaatcgaacaagctcaacaaaatacccattctgccgttgttcatcacggttttgatgagtcctttgaaagttgcattaaatgtaccgcttgtacggcggtttgccctgtttcgcgtaataacccgatgtatccaggtccgaaacaatcaggcccagatggtgagcgtttacgcttaaaaagccctgaactttatgatgaagcactcaaatactgcaccaactgcaaacgttgcgaagtagcttgtccgtctgatgtcaaaattggtgacattattgtgcgagcgagaaaccgtcatttagatcgccaaaacaaaccgctaatgcacaaactgcgtgatgctattttgagcaacaccgacattatgggcaaaatgaacaccccattagccccgattgtcaataccatcacaggtctaaaagcaaccaaattcttgcttgaaaaaaccatcaaagtgagccgtcatcgctcgttgccaaaatacgcttttggttcattccgcaactggtatatgaaaaaagagcaagaacgccaagccctttatcgtgaaaaagtggcgtactatcacggctgttatgtgaactacaacaatccacaacttggtaaagagttgattgatgtgtttaacgcgatggacatcggcgtaatgctacttgaaaaagagaagtgctgtggtttgccattaatggtaaacggcttcccagatagagcgaagcaacaagcgaaattcaaccttgcagaacttgaaaaagtggtgatgaaccgagagcttgacgtagtagggacatcatcaagctgtacaatgaatttgcgtgacgaatatcatcacgttttaggaatggacaacgccaaagtccgcccacacgttcatatcgtcaccaaatatctctatgaactgtttaatcaaggcaaaaaaccaaaattcaaacagatgccattacgcattgcctatcacaccgcttgtcacgttgataaagcaggttgggcgccttacacccttgatgtattaaaacatatcccagggattgaaattgtgatgttaccatcacaatgttgcggtattgcagggacttacggcttcaaagcggaaaactatgaaacttcacaagccattggcaatccgttgttccaacacatcaataacggtggttttgactatgtcgtttccgagtgcgaaacctgtaaatggcaaattgatatgtccaccaacttaacctgcctacacccgattactttgttggcgatagcgttggagagatagttccctctctaccaaacttcctgcttactttcatcgaaccttagtttattactcattaaccccttcccccacaaacggggggaagggcccgaaagagggatggggaaaatttaacattatggtatctactgttctttttatgcaaaataatgttgagtagctctaatgaaacattgatacctttctgctaattgtttataggtttgttttacttgtgtaatcaatctaaatatctatcagacgtaatttctttgtgaaagaagacagatggttatttaaaaaagggcttaaatccttgtactataaggctttaagccactttttagcaaccatttttctactatgcctaggtatagagagaaaaagaaaagccccgatgatttctcatcggggctaaaaatatggctcctcctgcgggactcgaacctgcgacatatggattaacagtccaccgttctaccgactgaactaaggaggaaaagagttgtaacataaatggtgcctcgaggcggaatcgaaccaccgacacggggattttcaatcccctgctctaccgactgagctatcgaggcatctcgtcgttacggggtgcattatgctgatttccgcccctctcgtcaaacgtttttttcaaaaaaataaaaaaatctgtttaacggatcgctttttattcaatttgtttaaaaaacaacgtgttatctcacgttacggtatttttgttgggctttatttaccttaaccaaatagtttcttgcttgtgaagatggatgagcggtggttaaaattcgataaattgctgacggatctaagttattaattcgctcaatcgccattaatttgtcattatcaaacactctcagtactgcgccagccccactattatatgctgaaatcattgcgtaacgttttgatgtaggatcagttattccttctagatactcatcacgcaaaatcgttaagaacattgtaccagcatcaatattctgacttgggttataaagataatcacgattaggctggccaccaaaacctttacgcgcaaaaatatcccgtccagctgtacgaggtacaacttgcattaaaccaatcgcattcgcataacttactgcataagggttaaatgctgattcaacttccataatacccagaattaagctcatatcaatgccatagcgttttgacatttgacgaaccaatggcaaatatcgtcttgcacgaacttcaacgtggtttgcaatcattggaatcgtgacataagtaacggtatgtccatttttcaagcggcgtgtttttaatttattttgcaataggtaagttgcaaaatcattagcaaccgccacattggttacagaacgcccatattgatccacaacttgacctgctaaaaaaggattattgctaataggaacatcacccgaagcaaataaatctatccctgtagcatctgatcccatcaataatgtgtgaataatcgaattacgcaagcggttgtgatccgccaaagtttcaatggtaatttgaccatcttcaaaactaatatggctacgggtgtaatatttgtccgtatattttacatagtctttctggcttgcttggagcagttcattaacgccccaaatttgatcgatattacgtgaaaattgccccatcaaaatatctaaaccattggtatttttagaataatcagggcgaggctttttagaaccttttctcgtcggcgtatcacttccacaagatgctaaaaaagggatcagcaccaataacggcaggaattttttatatttgttcattaggttatctctattttgactctacaggcacataaccttcaatatggacttcttttccttcaaacaaaaaattcaccatttctgtttccagaagctgacgatgttcagggttcatcatattaagcttcttctcattgactaacattgtctgctttttgatccactctgcccacgcttgtttactgattgaatcaaaaatacgtttacctaattccccaggataaagttgaaaatctaaaccttctgcttcttgtttcaaatatgcacaaaatacattacgcgccatttttctgtcctaatgtcaaagttaattcgtctaaaatgcgttttatcggggttgctaaacccacttcgctaggttgagttaaatcataccaataatccgctgttgaagatacacgcaaatgataatttccctgattttctgccaccccaagcggtaggacttcggcatttttttgtaaactaagttccgccaaaataggataaatatccaaatggaaatggctaaaagtatgccgaaaggcaattaattgtgtcatttgcaaatttttgcccgaaactgaccgcttgagatcgtctaaatgttcaaattgcggaaagacataaagtccgccccaaagtccttttgcttcacgtttttccaataagacttttgtcccctgttttaaaatcaaaaagtagctctgtttttcaggcaacgccttttgcggttttttggctggaaaatccgcccaagcctgttgagcatttgcctgacagcccttttctaacggacaaaggaaacatttcggcttagatcgtgtgcaaatcatcgcccctaaatccatcatcgcctgattaaaatccgccacttgcgaagttggtgtaacacgagcggtcagatcccacaatttattttcaaccgttttttcgctcgaccaaccttcaaccgcaaaataacgagaaagcacacgtttaacattgccatctaaaatcgggtaaggtgcatcaagtaccgaagagagtaccgccccagccgtacttctgccgacacctgaaagtgcaaacacatcagcaaaatctgtcggaaattgaccgccaaattcatctctaatttgttgtgcagccttatgcaaattccttgctcttgcgtaatagcctaaccccgtccataaatgcaacacttcatcaatgggtgcattcgctaaatcaataatagtgggaaaacgttgaataaaacgctcaaaatagggaataaccgttgccacttgagtctgctgtaacatcacttcagatagccaaacgccatacaaggttttattttgttgccacggcagatgtttacgcccgtattgctgataccacgccaacacgcctttggcaaaaggggcatccacacgagattgtgccaagggaaattcggatttttcttttttcatttagataatgatataagtcttaataataggggctgatcaacgttagctccaaagaaaatatttctatagttctttttggttttcccacacacaaacagggattataaacaaccattttatctaacatgctaaatactttacctacatatcattactcaatagaccaatttcgattgaatcaatctcaccatctcttgtaacgcttctgttggaggtgtgtcttgattcataaaccagcggaacagctctggatcggtatagcgaagcatttccacgaaagtgtactgttgctctgcggtcaaactatcaaaatgttcttgataaaacggcataatcattttatctaattcacgcataccacgacggcattcccattcaattctaaaacgactcatcagtttacctccgtaatgcgtagctctcttggcacttcaaaaacggtattttcttcacaaccttccagttcttcaactttggtgacaccgagtgtttttaagtgttcaaccacagactgcaccaacacttcaggggcagatgcacccgcggtaatgccgatcgttgtcaccccttgtagccagtttggatcgatgtcctgtggcccatcaattaactgtgaaggtgttcccattcgagaagctaactcggctaaacgatttgagttggacgagtttttagatccaactactagcactaactgtgctaattttgccaattctctcaccgcttgctgacggttcgtggtggcataacaaatatcatttttacgcggaccttgaattgcagggtatttctgttttaaggcttcgatcacatcaattgtatcgtcaatagataaggtggtttgggtcataaaagtaagatcttcatcttcttttaagccaagtttagcaatatcttccacatcttctacaaggaaaatgccacctttctcattatcatattgccccattgtgccgacgacttcggggtgtccttcgtgtccgattaaaattgcttttgtgcctttcttactcgctcgagcgacttgcatatgcactttggttacaagcgggcaggttgcgtcaaaaactttcaattcacgacgtttggcttcgtggcgaaccgcttgagaaaccccgtgtgcagagaaaatcacaatagcaccatctggcacttcatcaagctcttcaacaaatatcgcccctttggcttttaatccgtccaccacaaagcgattgtgtacaacttcgtgacgcacataaatcggtgcgccgtgaatttctaaggcaagctctacaatcgaaatggcacgatctacacctgcacagaaccctcttgggttcgctaaaataatgttcatttaattactctttttacttttacgatgttctaaaatggattctaaaatcagcaatcctgcccccaccacaataccaatatcggcaatgttaaatacaggataatgataaatgtcccaataaaaatctaaaaaatcaaccacatagccattataagcacgatcaaccgcattgcctattgccccaccaataatcaaggcataagctgaattttgcagtttgagctccgctttatttttaaacagcattacaatcaatgcaatagaaatgacaatagctaaacctaaaaagaaatatttttgccagcctgagtgatccgctaagaagctaaacgccgccccatagtttctcacataagtaagattaaagatcggcagaacattcacgctttcataaagctcaaagcgttgtaccacaatgtatttgctcaataaatctgtgattaataccacgacacttaaccacaaccacgataaacctgtttttttcattttattccttaaattgcttcttcgttctcttcgcccgtacgaatacgaataacacgttctacatcatacacgaaaatcttaccatcgccgattttgcctgtttgtgccgtatcaatgatcgcttcaatacattcatcaacttgctcatcagccacaataatttctaattttactttcggcagaaaatcaatcgcatattctgccccacgataaagctccgtatgccccttttgacgaccaaagcctttcacttcagtaaccgtcattcccgtaatgcccacgtccgtcaatgcttcacggacatcatctaatttgaatggtttaataatggcttcaatttttttcataagttatcctatcttcttgctgatttcggtctaaaactctcacaaatttcagggtaagtttcaatataaatgtcgcttaaaagttgtaaacagtagggaactgcactgaaaacaccacgaacaagcacttttccatcttgatctttcaccccttccaaagtttctttaattgcttttggctgtcctggtaggtttaaaatcagtgagctatgtcgaattgcccccacttgacgagagagaatggcggttggtacaaaatgtaggctcacttgtcgcatctgttcgccaaagccaggcatttctcgatgggcaacagctaaggtcgcatcgggtgtaacatcacgtttagcagggcctgtaccgcctgtggttaggactaaatggcaagcgtggttatcgactaattcaatcaatgtttgctcaataagtgcttgttcatcagggattaggcgagtttcaagctcaaaaggtgtggtaatggcagtttgtaaccaagcctgtaattcaggaatgccttgatcggcataaacaccggcagaagctcggtcagacacggaaactaagccaatttttaagatttctttgcttaaacaagcggtcattttctttctctttttgcaaatttagacagcttgttattttaccttgagagcctatttttctaaagtcttaatcttaaagatgaagtaataatattgaaagataataacggcaattaagatcagtttgccgatgatgtgagggattacaaagaaagcaaaaatacagaatggcacagaaaacgccaaaatactgattttctgtttaagtgtcatggctcgtgtttgatcgaaagacttgagatatttggaatagatagtggtagataagaaccactgttttagtcgtttagaacctttgccaaagcaatataatgctaaaagcaaaaacggagtggttggtaacccaggtacaataataccgattaaacctaatatcattgagataaaaccgagtaagatgaatagtgctttcatgtatttaagggaaaagtagtgatggatgttgataatacgttaattcaattcatttttcaacgaagcaagcaactagaaagtatataactatttttacagcctaaaaaagcatagtggacaaaagagttggttctgtttttctaactttcactaactcttttgattacggcatccctaaaatatgaattgagatagggacgattagtttcctctcaatgacatttcacctgtcgcaaaacggcggataatttctccttgctgtaaaatcaattccccttcttcattaatcccaagggagatcccatgaatttcttcattttcagtgattaatctaaccgcttgatgacggaaaatatcaaactgttgccaacgttccgcatagggttcaaaggtggtttgtgggtaagtcactagggcattttgtaaatgtttagctagctcagcaaccagttgggaacgatctatctgatgttctgagagatcgctccaagcctgcgttaccacatttttatcgacagtgttcattcctaaattcaagccgatgccaatcacaaggtaaattcccgttttatcgacacggctctcaattagaatgccccccatttttttaccttgatagtaaatatcattgggccatttaatttgaatatgcggtacgttcagtgtttggaaggtctcggcaattaatactgagaccactaaacttagtgatgagagctgtggaatatccaatgaaggatagtgccataacattgaaaaataaacgttttgactttcaggtgaataccactgccgtccacgtctgccacgccccgccgtttgggactctgcaacacaaagtgagcctgacggtaaggttttatagtgcgtcagtagatattcgttagtagagtcaatctctttaaatacaagagtttgtccttgcgttaatgccgatgtaattaaatgttgatcaaatcccattaccgatcaccttgtcacaaattcactatccacttcgccctgtcgtcccataaaacgtacttctgggtgtaattccacgccaaatttttcacggacttgacgacggacttctttggctagtgccacaacatcagtcccagtagcattctctttattaatcagcaccaacgcttgttgggtatgaactgccgctccaccgatttggaagccttttaaatttgcttggtcaatcaaccagcccgaaggtaatttgaccgaaccgtccgcttgcggatagtgtggaatattcgggtgagcggtttgaatctgctgaaactttgcaaagtccaccacaggatttttaaagaaactgcctgcattaccaaactcatcaggatttggtaatttcgctcggcgtacggcacagacttcatcaaacacttgctgtagcgttactgtgtttggatcaaattgtgccaaagaaccgtaatttaaaacaggttgccacgcctttgctaacttcaaaccgacagccacaatcgcataatgctcacgatattgatgcttgaatacactttctcgatagccaaactcacactcgtttttcgttaaacggaacagctcacccgttttgagatttagtacatcgacataatcgcaaacacgctcaaattctaccccgtaagccccgatattttgaatcggtgcagagccagcaacaccaggaattaacgccagattttcaagcccgccaattccttgttgcaatgtccattgcactaactcgtgccaattttcaccaccagcaacttgtagatagtgaaagtggtcgtcttgacgatgctcgatccctttgagcttattgactaatactgtgccgtcaaaatcatctaaaaacagcacattagagccttgccctaacaataaaatcggttgttgtgcgtgatcagctttttgccattcggttaatagttgttcaatactgttgaactcgataatgaccgatgcttttgcaggcaaatgaaaggtatgaaatggggttaaggtctgactcattgactactccaaattctgaatttgctcacgcatctgttcaattaacactttcaactcaacggcagaattagtgacatcagcgttaatcgattttgatgccagcgtattcgcttcacgatttagctcttgcatcataaagtctaatttacgtccaactgcaccgccttttttcaaaatagacgtggtttctttgacgtgtagctgtaagcggtctaactcttccgccacatcgactttttgagccagtagtaccatttcttgctctaaacgttgtggatcaagttgcaagttcagttcatcaaaacgctgttgcaagcggtctttttgccactgtaaaacgctcggcatttgagcctgtacttttgtcgcttctgtggcaatagcgtctaaacgttgttgaattaaggcttgtaaattcgccccttcacgtccacgcattgcgataaattctgtaaggatctgctcaaaaccgtataataaatcttggctgatctggtcgagatcttgattttggttatcgacaaccccagggaaacgcagaatatccaccaagttaatttcgccttcttgagccgtttcttttagccattgtaatgaacttatcacctgtttggcatactcttgatttaaagctaagccattgttttgattagcatttaattcaatgcgtaaactacactctactttaccacgggttagtgtcgtacgcagacgttcacgcaaggtcatttccaaattgcgaaaggcttcaggcagacggaaataagtttctaaaaaacgttgattaaccgaacggatttcccatacggcgttaccccactcttttttaagctcaaggtgggcgaaagcggtcatactgtaaatcattgtactcttttctctttgttacaaaatttggcatattgtacttggtattctgctagaataggggaaattttttagagaaagggaataaatatgcgtccaaataatcgtcctgttgatcaaactcgtcctgtaaaaatcactcgtaactatactcgctatgccgaagggtctgtgttggtggaatttggtgaaaccaaagtgctgtgtaatgccactgtcgaagaaactgtaccacgttttctcaaagggcaacaacaaggttgggtgacagccgaatacggtatgttgccaagagcaacccatagccgaacccaacgtgaagcggcgaaaggcaaacaaggcggtcgtacaatggaaattcagcgtttaatcgctcgctctttgcgtgcagtcgttgatttgaaagccttaggtgagcgtacaattacggtagattgtgatgtgatacaagccgacggcggtacacgcacagcgtctatcacaggggcttgcgttgcgttacacgatgcgattaacaaattgatcgccgatggcttattgaaagaaaatccgatgaaaggattagtggcggcaatttctgtagggattgtcgatgggcaagcggtctgtgatttggaatatgtggaagactctaacgcagaaaccgatatgaatgtggtgatggttgaagacggtcgtttagtggaagtacaaggcactgccgaaggtgaaccgttcagccatatggaattattgcaactccttgatttagcacagaaagggattgagcagttgtttgaagcacagcgtcaggcgctaaatgcaacttctgatgttatacgatagtcgtacaaaaattaaaattttaagaaatcatttaggggattattcccagcaatattggggcatagtagacaaaatagtcgctatgccaattttttgaaacatattatgtcaaaataacttactcaaccagcccaattttgaacctaaaacattaaagtagttgtaatcttttaaatgcaatagacgcaacttatccgggcttttttgcacaagaatacgttcatcagggctaaacggcagtaaacgttggctatcacagctaatcactaaatttgactgattgtactcagcaaaacgcattgaaataacactatcgccatcgacaaccaaaggacgagaagaaaggctgtgtgggttcatcggaacaagagcaatcgcatttaaattaggggttaagattgggccaccggcggaaagcgaataggcggttgaacctgtaggtgttccaataattaacccgtcggaacgttgcgaaaaagcaaatttgccatcaatactcacttcaaaatcaatagtacgagcgatttggctagagtgaacgacaacttcattgagggcattatttgcttcaatgatcttaccattttgctcaattttcgcatcaagtaagaaacgttcttcaatcataaactcgccacgctcaaggcaactatgcagttgctcaaaggctgtttgaggggcaatatctgttaaaaaaccaagatttccacggttaatgccaatcagtggtacacgatatttcgctaattgccgagccatacccagcatattaccgtcaccaccaatcacaattactaaatccgcccattcgccaatttctgcaatgctcatcgggttagctaaattgagttgagtggcaattttttcttcgactaacacattatatttacgatcttttagccagttatacacagctaaatgcgtttctaaagctatatcgtgacgaggtttgccgacaatcgcaatggtttgaaatctacggtgcatcatttgaactcgttatctaataaaatttggctatatggtagtacgcaatctgctgtttgtcatctttttcctatcagcttactaattgtttaaatcttagggataaataaaaaattaccctataaaatagggtgtcatctattttatagggttagcatgaatttaactaaaaatgaactaaataaaagagttattgatgatttcttattcgttttatagcgtataaattaatttttattcatcatcctagaaactctttatgtttaatcaatcgccggtgtatattcaccttttgcaattgcatctttgatacgctctgcttcactcaatacttgagctaataaagcctgaacgttttctaaggtcgcaattggacttaaggtggtcatttttagcgattgtatgttgttcactttggttacgccgatattcgcttcgccacgggcaaagagttcatctgcaacgttctggttcaaggtatcaacaaactctgctgggtagccttgcggtacaacacggaacaacacggaagcaaattgaggttcaactaatagctctaagccgtcggtcgctttgatgtagtctgcaacggcacgagttaatttcacgccgtggtcaatcattgaaccgtaaagattttcaccaagggcttccaccgtaaaccataattttaatgcgtcaaaacgacgggtggtttgtagtgattttgccactaagtttggtacgccgtgttcttcgtcatactctgagttgagataatctgctttgtagtcgatgtagcggtattcgttttcatcttttaataaaaacgctccacaagagatactttggaagaagtgtttgtggaaatcaagggtgattgagtcggtgagctcgataccgtctaggaagtggcgatattcattggatagcagtaatgcaccgccccacgccgcatcaacgtgtaaccaaacaccgaatttattggtaatcgcacgaatggctttgagtggatcgatcgcccctgcgtccgttgtgcctgctgttgccacaacgcaagccacaactttgccttctaaataaagtttggctaaggttgcttccaacgcattgatgtccatttgggcattttcattgcacggtacagttacaacagattggaaccccattcccatcattgccatatttttttgcacagagaagtgtgcattttccgagcaaaccacttttactttttgcattgcatcaggcggaataccgttacgttgcactgaccattctgtgccgtcggcatttttccagtgttttgcaatgcacgcatcacgagcaagtaatacgcccattaggttagattgcgtaccgccagaagtgaaaacacccgcttgtcctttgccgtagcctactttttcacgcaaccactcgatgagttgcacttccattaatgaacctgctgggctttgatcccaagagtccattgattgattggtggcattgattaatacttcggcgatttggctggtgaccattgttggacagtgtaaatgagccaaagagtgtgggtggtgtacttttaaacttttgttgaggaataattcaattaagcgatctagggatttagcaacgcccaagccttcttttgatgggttaaaggcaatttctgagcgtagctgtttaatgctaccgccggtgtacattttttcattttgtagccagttactcaccgcttgtacggcggtttccattgagctttggtagtctgcaatagattgagcgtcattgcagaatagggcttgtttgtgttttgaaatatcagccatttttcttttctcgtagggtgcgtatcaacgcaccgtattaatagacgaaaggtgcgtttacacgcaccctacaagcggtcacatttggtaaaaattttgcaattcccgaccgcttgttaacgaattatccacgcactgtgctcaacgcatcggcaaccgatttgctgaaacgtttaatcatctcttcacattctgcttgagtgatgattaatgggcaaaggatacgcacaacgttaccgccacgaccgccacgctctaacaataatttgtttttaaagcaggctttttggatttccgcagcaagtccgctatctgcagggtaagaaccgatgcgatcttgtggctgacgctcatcaacaatttcgatccccatcatcaaacctttaccacgaacgttaccgatacacggatattgttgtgctagtttttgcaattctgcttttaagaatgcaccacgctcttctgcgtttttcgccagattttgctcacgcataattttaagtgacgcataacctgttgccattgctaattggttaccacggaatgtacctgtgtgtcctgctggctgccaagcgtcaaactcttttttgatcgcaagtacagcaagcggtaagctaccacctacagcttttgacattaccacaacatctggctcaatgcctgcgtgttcaaaggcgaacattttacctgaacggcagaaccctgcctgaacttcatctaaaatcaacacaattccgtgttttttcgttacttcacggattttttgtaaccatttcactggtgcggtaaccacaccgccttcaccttgaattgcttcaagaataacagctgctggttttaccacaccgctttcaacatcttcgataaagttctcaaaatagtaagttaaagcatcaacaccttctttaccaccgatacctaatgggcaacggtattcgtgtggatatggcataaactgtacgcctgccattaagttttgcacggcatttttcgcattaaggttacctgtcattgagagcgaaccgtgggtcataccgtggtagccacctgagaatgcaattacattaccgcgacctgtataggttttcgctaatttgattgctgcttctgtgccgtccgcaccagaagggccacagaattgtaaacggtattcacctttcgggaagaaagagagtagttcttcggtaaaagcatcttttaacggcgtagttaaatcaagggtatgaagcggtaaaccacttgctaatacatcttgaatagcctgaataacggctgggtgattatgtccgagtgctaaagtacctgcaccagccaagcaatctaaatattcgttaccttcaacgtcagtgacccagcaaccttgtgcttttgcaattgcaagcggtaatttacgaggataactacgaacattcgattccatttcgttttgacgagttaagtaatattcgttagttgcttgattgatcggatttacaggaattgttgtcatttgaaaatagaccttctataagaggttaaaaaaataagtcgggtgccttgcgggaagcctaagctttcttatcttgaaagataagatgccttggggcatttgactcgctacttattaaaaaaagcgtttcagcttttttgtttttaccctattgctccctaggattggataggttggaaacaacgcctcaaatgttgggttatatttgaggacggcgtatagtagcgatttttaaaaaaagaaaagttttttctgaataaaactttacctgtgatacagcgagcttaattgtttagaataagtctttgggagatttttgtagggatgttatttttaatttgttgtttggcgtaatcaattgcatagaaaaacgctcgctcacttgccccaccatggctttttacaaccacggacgataagccgagcagtgtggcaccgttatggcgatcagggttgatctgttgtagctttttatagtaacgataaaagattaaacgtagtaaataacgtttggtattgcgacaaagatgtgaatcttccgttgtttttttaaagagtgaaaggatattttttgccgcaccttcaagtgttttaagtgcaacattaccgctaaatccatcgcagacaattacatcagcaagatgattcattaatttatccccttctaagaagccaatgtaatttagatgattacattgttttaattgctggtgagcatctcgaatttgctgtgttcctttatgctcttctgttccaatattcagcaacgctaaacgtggatagaccaaatccaacatcacttctgcaaacacattgcccatttccgcaaactgaagcaatagttcactatctgcttcaacgtttgcaccaagatctaacatcacacttgagttgccgttaattgttggaatcaaagatgttaatgcgggacgatcaatgtttggcaagggttcaatcaattgttttgccagccccattagtacacctgtatttccgccacttacacagccttgagcatttccattttctaccgcttcaatcgctaaacgcattgaactgcctttactttgacgaatcgcttgcacaaaaggcaagtctgcttcgatcacttttgttgtatggactaattcgatacgttgttgaatatcgggagaaagtttattgagatagggggatatttcagcttggtctccgaacaagatgcaactgagtattggatgttgagccaacgcaagtgataatgcggggatagtaatacggggaccaaagtccccgcccatcgcatctaacgcaagagttagatgagtcaatttaaacctctacgagatccaattgattatttgattttacgaccacggtaataaccgtcagcggtaacgtggtgacgtaagtgggtttcgccacgtgcatctacagatactgcagctgtggttaatgcatcgtgtgaacgacgcatatcacgacgtgaacgagatttcttattttgttgaacagccattggctatactcctactagatctagtttttctttaaattagctaatattgcgaaaggatttggtttctttgccagttcttctggtaattcgccaaaaactaattcgctttcggacacttcacagtgttcatcggtatgcatcggcactaggggtaatgacagaatgaattcgtcttctatcatatctagcaaatttatctcaccaaaagaatcaacttcaattggttcataaatctcgggcaaattgtccgcctgatccatattagacactggactgaaacaaaatgtgcagtcgagtgtttgcgtaaatgggttactacaacgttgacagtctagctccacatcaactttcgcagtgcctttaaccactgtgagtttttgcggatcaacatataacgataaagtaacttgtgcatcgcccagcacttgaccaacagattcacccaaacggctaagtaggttcgcagaaatgtagccttcgtagtccattcgacgctgagcgtctttatatgggtcaatagttaggggtagttttaccttttgcatagggtgcgaatattacagattttgaagtaactagtcaaagagaaaatctggatttgtaaaaaatccgtagaatcatgccgcttatatgtatctattacattatttggtgaaatttagtagcaatcccaccgcttatatgttaaaacgttcgccgtttttatttaacttacaagaaggaaatgcaaatgtcattacaagcaattattgaagcggcgttcgagcgtcgtgctgaaattactccaaaaactgttgatgcacaaactcgtgcggctgtcgaagaagtgattaaaggattagataatggttcactgcgtgttgcagaaaaaattgatggtgaatgggttgttaatcaatgggtgaaaaaagcggttttactttcattccgtatcaacgacaacgaaatcattgatggtgcagaaactaaatactacgacaaagtaccgaccaaatacggtaaatatagcgaagagcagttcaaagcagatggtatccgtgctgtaccaggtgcggtcgttcgtcaaggttcacacatcgagaaaaacgtagtattaatgccatcattcgtaaacatcggtgcttatgttggcgaaggcacaatggtggatacttgggtaacggtgggttcttgtgcgcaaatcggtaaaaacgtgcatttatcaggtggcgtaggtatcggcggtgtgttagagccgttacaagctaacccaacgattattggtgataactgttttattggcgcacgttctgaaatcgtagaaggtgtgattgttgaagatggctgtgtgatctcaatgggcgtgtttatcggtcaatcaaccaaaatctatgatcgtgaaacaggcgaaatccattacggtcgtgttcctgccggttctgtggtggtttcaggtagtcttcctgcaaaagatggttcacacagcttatactgtgcagtgatcgtgaaaaaagtggatgcgaaaacattaggtaaagtgggtcttaacgacttattacgttctatcgaagagtaattttcgcactgaatggcacaagcaacggcttgtgcctcttttttggagatcttgtatgacgacctattcgctacgtttaaaagccaaaaatgagctcacgccgcatccaacggcacaatattggcgtaaatgccaagttgaagaactttttgatttgccttttatggacttagtttttcgggcggcagaaattcatcgacaacattttgatccaaatgccattcaactttctacgctactttccattaaaacgggcggttgcgctgaagattgtgagtattgcccacaatctgcccgctatgacacgggtgttgaaaagcaaagtatgcttgatgtgaactatattgttgagaaagcccaaattgccaaggctcgaggagcaagccgtttttgtatgggagcagcgtggcgaggtcctaaacctaaagatattgagacggtctccgccatcattaaagcggtcaaatccctaggtttagagacttgcggtactttcggtatgttagaagaaggtatggcggaagatttaaaagaagccggattagattactacaatcataatttagataccgatccggaacgctatcatcaggtcattcacactcgttctcacgatgatcgaatggataccttaggtaaagtgcgctccgcagggttaaaaatctgttgcggcggtattgttggtatgaatgaaacaagagctgaacgagccggacttatcgccagcttagccaatcttgatcctcaaccagagagcgtgccgattaaccaattggttaaagtggcaggcacaccacttgaaaatgcagaagatctcgattggacagaattcgtgagaaccattgctgttgcgcgtattacgatgccaaaaagttatgttcgcctttcagccgggcgtagcaatatgccggaagccatgcaagccttgtgttttatggccggcgcaaactcgatcttttatggggataaattattaacgacggaaaacccagaagaagatggcgatagagtgctgatggaaaaattgaatttatatccattaagttgttcgaatgttgaatgataaaagtaattacaacataagtagctaaattctctcccctctcccacaaggggcgagggttagaatttgataacattgcaaaatcttgctcatttttaaccgcttgtaaggataatataatgaaaaaaatcttgttattaaacggacctaatttaaatatgctagggaaacgagagccccatatttatggttcacaaaccttagccgatattgaaaaccacctccaacaattagcgaaggcaagaggctattgtctagagtattttcaagcaaatggcgaagagccgattattaaccgtattcatcaatcattccaaaataccgatttcattatcattaaccccggtgcgtttactcataccagcgttgccttgcgtgatgctttattgtcagttgctattccttttgttgaagtccatttatccaacgtacacgcccgtgaacctttccgtcatcattcctatttaagtgatgtcgcaaaaggcgtgatttgtggattaggggcaaaaggttacgattacgccttagattatgctattcaatttctaaagagtgggaaataaatccattttttgttgtctgaagtaaaaaaagaaaactgaactgctacgattagtggcaaatttgctaataaattcggcaaatttatcagattttcgtcgcaaattaataaaatttcaggtaatctacgcaaaattttgctctatgttctttgaacatagagtttgtttatttttacattcaaatacggatctcattatggatattcgcaaaattaaaaaacttatcgagttagttgaagaatcaggcattactgaattagaagtgtctgaagaagaaggcacagtacgtattagccgtgcagcaccagcagttgcacctgcggcagtacaatatgttgctgcaccacaagcagcgccagcacctgcagcaacccctgcaccagcagctcaaacagcacctgcggcagcgccagcaccaacagcggaagtatctggtcacgcgattctttcaccaatggtaggaacattctatcgtagccctagcccagaggccgcaccattcgttgaagtgggtaaaaccgtgaaagtgggcgatacactttgtatcgttgaagcaatgaaaatgatgaaccgtatcgagtcagacaaagcaggggtaatcaaagcaatccttgtaaacgacggcgaagcggttgaatttgatcagaaactcttcattattgaataatccatttcttacaagcggtcagatttttgcaaaaaattgcacgaaaaagaccgctttcaattaagggtatctcttatgttagaaaaagttgtcattgcaaaccgtggcgaaattgcattgcgtattctgcgtgcgtgccgtgaacttggcattaagacggttgctgttcactcaacggcagaccgtgagttgaaacacgttctccttgcggatgaaacagtatgtatcggtcctgcgccatcaacaaaaagttacttaaatattcctgcgattattgccgctgcagaagtaactggtgctgatgcgattcaccctggttatggtttcttatctgaaaacgcaaacttcgcagaacaagtagaaaattcaggctttatctttattggtccaacagcagatgtaattcgtttaatgggcgataaagtttctgcaattaatgcgatgaaaaaagcaggcgtaccttgtgtgcctggttctggtggccctatcggtaatgatgtcgccaaaaataaagaaattgcacagaagattggttatccagtgatcattaaagcatctggtggcggcggtggtcgtggtatgcgtgtggttcatcacgaaaaagatttggaagaatctattgcgatgaccaaagcagaagcgaaagcagcctttaataacgatatggtttatatggaaaaataccttgaaaatccacgccatatcgaaatccaagtgcttgcagatacacacggcaatgcggtttatttggcagagcgtgattgctctatgcaacgtcgccatcaaaaagtggtggaagaagcaccagcgccaggcattacccctgaattacgtcagtttatcggtgaacgttgtgcgaatgcgtgccgtgaaatcggctatcgtggtgcaggtacatttgaatttttatttgaaaatggcgagttttatttcattgaaatgaacacccgtttacaagtagaacaccctgtcacagaaatgattacaggtattgatcttgtagaagaacagcttcgtgttgctgcaggtttaccaatctcagttaaacaagaagatattaaagtgcgtggtcacgcgattgaatgccgtattaatgcggaagacccaagtacattcttaccatcaccgggtaaaatcacccgtttacacgttccaggtggattaggtgttcgttgggattctcacatttatgctagctattcagtcccaccgcattatgattcaatgattggtaaattgattacctttgctgaaaatcgtgatattgcaattcgtcgtatggaaaatgcattgtcagaaacgatcgtggaaggaattaaaaccaatatcccacttcataaacagattctttctgatgaaaacttctgcaagggtggaacgaatatccactatcttgagaagaaattgggtttaaaataatgatatagtagaaaacatatctgctactatgtcaaaatagatacaataaagccctaccttacggtagggcctgagaaaagatgtaattataaactttcagtgaaagtacgagtaataacatcacgttgttgttctggtgttaatgagttaaaacgaactgcataaccagaaacacggatagttaattgtggatatttctcagggtttttcactgcatcttctaatgtttcacgacgtaatacgtttacgtttaagtgctgacccccctcaactttaatggttggtgcaacattaactgggacttcacggtatgaaacttgacctaattcgctgattgcaactatttggtcttcttggaaatcacctttagctgctaagcaacgtgcttcatttttctcttcatctaataaccagaaagagtttaataagtttttgttggtagattcagtgatttgtacacctttgatcatttttagctcctagtatgttgggtaaattataaaaaaagtttaaagtttcaaaaaattttgagtattctaactttaatcctttaaaaagcgagaaaaatttaagcatttttatcaaaaaaactgatgatggcttaaaaaatagacaagagttaacagttcattttaatttttaacaatttaataataggatagaatatgaacagttggactgatgccattggggaagaaaaaacacaaccctattttcaacatattttgcaatatgtacatcaagaacgtttagttggaaaagtaatttacccacctcaaaatgaagtgtttagtgcttttgctttaactgaattcaaagatgtgaaggtagttattttagggcaagacccttatcacggccccaatcaggcacacggtttatctttttcagtaaaaccaggaattgttccgcctccctcgctggttaatatgtacaaagaattatcccaagatgttgggtttcaaataccatcacacggctatctcattgagtgggcaaaacaaggggtgctattgttaaatacggttctcaccgttgagcaaggaaaagcacattcacacgccaatatcggttgggaaacctttactgataaggtgatccatcaactcaatctacatcgtgaaaatctggtatttttgctttggggaagccatgctcagaaaaaaggacaatttatcgatcgctctcgtcattgcgttctcacagcccctcacccatcaccgctctctgcacatcgtggctttttaggctgtcgccatttttcaaaaaccaatgattaccttcgttctcacggagtcgaagaaattaattggcagctgccattataagtaacatgctaggaatatctaagagatttcctaacttatattgttgatttggactggctcaataatttcacttggatagcaacccaatacttttaagaaactcgtcactgtttcaagttctttcaaggcattttgggtattttcattgtgaatattggcatctaattccacatagaacatctcttcccacggtttaccataaataggtcgagattcaagtttaatcatacgaatgccgtgttgcttgaacaccatcaacgcatcaaccaaagcacccgcttgttgagtcgtcgtcattaataacaaggttttggtctgtacttgtggcgaaacattgatagtttttttagacactacaataaagcgagtaatattgttttcttgattcgcaataccactttttaacacgcttaaaccgtacaatttcccgccatcttcattacctaacgcaacgcaatttggtttatttaaacgagccactaactgcatagcgtgagaactactttcacagtatttgatatgcactttatctaaactatgaataaattggctacattgttgtgcaggttgtgggtgggtataaatggtatccacttgggcaaaatcagcattgtttgttcctaaaacacagtgtttaataggataagctaattcgcctacaagggttaagtctgtatgttgcaacaaatcataaacttcattgatagaacctgatgtggtattttctaacggcaacacgccataatcggcttcatcttgctgaactttttcaaaaactgaatcgaaagattcgcaactgagttccactaaagatgccgtgctgtttttcataaactggcgagaagcaagatgagaataagagccacgcatacctaaaaatgcaatggtggcattttcttgattctgattcagtttattttgcaagtaatgttgctgtgttaagacagagtcttcaatgatacgttggaaaatttgcgttacatattgtgggtcaagttgataattttccgcttgagcaaaactaaccaattcttgtaacagttgtttttcacgttcgatatctcgtagaggctttttcgtgatctctttgcttctcactacatcgaacgcaagtcgatgacgctccgataataatttcaataagttgcggtcaatttgaatgatttgttgtcgaatatccgataaatctaaagacattgcgttttcctaagcggtcggttgtgtttaattttttgcagtttgcagtttgtatataactgaaattttaacggcttcccccataaatcacaatcaactaatgaaaataatcgctaaaatggtaagatgtcgcacttttatcaaataaagaggaaatcgaatgtcaaatccacttttaaacaacacaagtttacctaaattctctcaaattcaacctgaacacgttgtgcctgctattgagcagttaattcaacaatgccgtgatacgattgaacaagtttctcaaattaatacaccaacgtgggaaaacttctacctaccgcaagcaatcacaggggataaactctctcgtgcgtggtcgcctgttgggcatctcaattcagtaaaaaatagctctgaattgcgtgaagcttatcaagcgtgtttgccgatgttatccgaatacagcacttgggttgggcaacatcaggggttgtatcaaggctatgtcaaactgaaaaatagccctgagtttgccacttattcgctcgctcagaaaaaagcgattgaaaacagcttgcgtgattttgagttatcagggatctcattgccagcagataaacaaaaacgctatggcgaaatttccgctcgtttatctgaacttagctcacaatttagcaacaatgtccttgatgcgacaatgggttgggatattgtgattgatgatgacgcagatctgaaaggcttgccagagtcggcacttgaaggggcgaaactttcagcacaaagtaaagagaaatcaggctaccgctttacccttgagtttccaagctatttgcctgtgatgacctattgtgaaaaccgtgagcttcgccagaaaatgtatgaagcttataacacacgagcgtcagatcaaggtccaaatgcaggtaaatgggataactctgcaattatggcggaaacccttgagttacgcttagagttagctaaattactaggttttgaaagctatgccgagctttcccttgcaaccaaaatggcggaaaacccaacgcaagtggttgatttcttggaaggtttagcaaatcgttctaaagagcaaggcaaaaaagagttagctgagctaaaagcctttgcaaaagagagatatggcgtaagcgaattacaaccgtgggatattgcgttttatagtgaaaaacagaaacaagccttatatgcgatcaacgatgaagagttgcgcctttatttccctgaagaacgtgtgctttcggggttatttgaactggtgaaacgcatttttggtatgcgggtggaggagcagaaagaatttgatagctatcacgagaatgtccgttttttcaatattttcgatgaaactgaccgcttgcgtggctcattctatttggatctatatgcccgtgaaaataaacgtggcggtgcttggatggacgattgtatcaatcaaaaacgtctagcggacggttcattacaaaaacctgttgcctacttaacctgtaacttcaataaaccgattggcgataaaccagctctgtttacacacgatgaagttactacgctgttccacgagtttgggcatggtattcaccatatgctgaccgaaattgatgtgggtgacgtttcagggattaacggcgtgccgtgggacgcagttgagctaccaagtcaattccttgaaaactggtgctgggaagaagatgcccttgcctttatttcaggacattaccaaacaggcgagccactaccaaaagagaaattgacccagttgctgaaagcgaaaaacttccaagcagcaatgtttgtgttacgccagttagaatttggtttattcgatttccgtttacatatgagtgagccgaaagaaaatattgtgttagatacgctaaaagcggtaaaagcacaggttgcagtggtggaattaccgactttcgtgcgtaccccacacagcttctcccacatcttcgcagggggctatgccgcaggctattacagctacttatgggcagaagtattatcggcagatgcctttgcacgctttgaagaggaaggtatttttaatcgtgaggttgggcagtctttcctagataatatcttaacccgtggcggttcagaagagccgatggtcttgtttgaacgcttccgtggtcgcaaacctacgttagatgcgttgttaagacataaggggattgctcgtcaagaggataagacttggtagcataatacattaaagaaaagagctggcttgtatgcattaatttgaaaattgttgaatataaatcatatattccaagtgattcaatcaacgttgataatagggatgagacaattcattttgttgcaaaagttcataaatccgctatactcgccagcctgagttggttagacaatcgctggtttattgaagcccttaaccgttcgtaagaacgacctagtgggacaagtaaacgagaggaaagtccgagctacacagggcagagtgccagataacgtctgggaggcgtgagcctacgactagtgcaacagagagcagaccgccagtttctgctggtaagggtgaaagggtgcggtaagagcgcaccgcgtgagtggtaacatttcacggcacggtaaactccactcgtagcaagaccaaataggaatccaacgagttgcccgcttgggattcgggtaggttgctcgagcgtatgtgtgaatgtacgcctagaggaatgattgtccacgacagaactcggcttatcgaccgactcagcctaatttttaagagcgaacagattttgtctgttcgcttttttattgaagcatgtcggaacaaaaagcccttataaaagtctgatataatgattttaaaattgatttcattataaggatttcaaatgcttaagcgttttcttatcggcacgatttcgttattactctctttttctgtatttgcccacccacattctttccttgatatgaaaaataaagtgttaattcaacaaggtaagctggaaggttttgaattgtactggacacttgatgagattacatcagctgaactgatctatgaaatcaacagcagtaaggataaaaaacaggcaatgaataaaattttgcgtgagttagatgaatctgcggtgagtacccactattttagcgagctttataatcagcaaaatgaaccgattaagtttaaagctaaaccgcataactcgtccgttgaaattcagcataatcgtattatttaccatttcaccttgctactagccgagcctaaagcggtaaaagggcagtcattccgttttttacctttgagccaagttattacttagcaatgaattacgaaaaagcgagtgatgtcagtagcacagagcaaaatctttgtaaagttgagatgattgagccgacggtaaatcaatctttgcggttgtatgcatcgacattagataaaaatgaaacccccgatatgccagcagaacgtggcttgtctttaggcgcacaatttgcgcaaaaagtgagtattgtatgtcaataaaggcaaagtattgggctgggatagcggtcggattggtagctctttttgcgatttatcaggcttatccctatctcttatttaaagtcagcgagtggcagagggaatttaattttgccctttcaggggcgttaaatcgtctaaacgaaaaccagcaacaggcagggctgagcttaatggcggtgagttttatctatggcgtgtttcacgccgtcggcccaggtcacggtaagtttattctgaccagctatctctcttttgaacaaaccaaactgccacaagcggtgaaaatcacgttgttgtctgcgttagtgcaaggcttggtggcgattgggttagtgacgattattgtggtgatttttaccctttctcgtagctattttaatctagcgttaaaatgggttgagcgaggcagttttgttgtaatgatgttgtttgggctttattggtgttatcaagcgttaaaaagcgtgagagcaaagccaaagggctttcaaattcgccatttgcaaaaaatagccccaaaatcaccgcttattactgctcatcatcaacattctgcagattgtggctgtgggcataaacatttgccaagttcatctgaaatggcaactgcaacggattggaaaagcacgctgatgttggtttttagcattggcttacgcccttgttcaggggcaattttagtgctgtttttagcttataccttggatttgtacctgtggggggtagcttctgcgttattaatggcaacgggaacggggctaacgctaacgctttttgcctgtttggtacttttcgctcgccgtaaagcggtgcatattagccattggtatctttcattttctgctcacaagcggtctgttttattcggaaaattgctgattggattacttttgatcggttttggttttaccttattccacagtagtttgttagatacaagccaaaatcttttgtttaagcgttaagttatgtcatattcaatggacgccgagcgtggtgtcccttgtattatttgctaattagacagaatttgttatttaaaccagtccagctcgctaaataactaatcattaactttttttatcattttaattaaaaaaatcttttcaaaagataaaaaatcgttaaaatgccgaaattgttttacttttttatgaggtcttttcgatggatagcatcgtttcaatttttgaagatgttttaaaatggatcgtgaacacgattgacggtccactttgggatattactgtattaacccttttaggtgctggtttattctttaccattaccactggcttagttcaattacgtttattacctcgtagtatccgtgaaatgtggtctggccgtgctgcagagggcgagtcattaaccccgttccaagcctttgcaacaggcttggcaagccgtgtgggcgtgggtaatatcggtggagttgcgactgctatcgcattaggcggaccaggtgcagtgttctggatgtggatcacggcgttaataggtatgagtagtgcatttgcagaatcatcattggcacaggtttataaagtgcgtgatccaaacggtatgttccgtggtggcccagcttattacattaagcgtggtttaaaagctccttggcttgcgattgcctttgcaattaccttaatttttaccttcggttttgcgttcaatgcggttcaagcaaactctatcgttgaagcaacgcgtaatgcgtgggaatgggatccgcattatgtgggcattgtgttagtgattgtgactgcagcgattatcttcggtgggattaaacgtatcggtcaggtttcagcgaaagttgtgccgatgatggcgttattctacttaattatggcaatgatcattttaggggtgaatattgagcgagtacctgaagttttaaataaaattattaccagtgcctttgacttttctgcaatggctggcggtatctttggttcattattctcacaagcgatgttaatggggattaaacgtggtttattctcaaacgaagcgggtatgggttctgcaccaaactcagcggcaacgtcagatgcaaaacaccctgcaagtcaaggcttaattcaaatgttaggggtatttgtggataccattattgtatgtacttgtaccgcaatcattattttaatgtctaacgattatggtagcgaatcattgcgtggcgtatctttaacccaaaaagcgttagagttccacatcggtgaatttggcttacacttcttagcctttatcttattgttattctgctacacttcaattatcggtaactatgcttatgcagaaagcaatattcgctatatccgtaacaaaccaagtttcgtattagccttccgtttaatcgtgttatttttcgtttacttcggtgctgtgcgtgatggcggtattgtttgggcgtttgccgataccgtaatggcatcaatggcgatgatcaacttagtgtctatcgttttacttgctccaattgtttgggttatcttaaaagattaccaaaaacaagtgaaagcaggggtagagcagcctgtattcaaaattgaagatcacccagagcttattcgccgtggtgttgatccgttaatttggaagtcaaaagagtaacctattaaaagtttaatctaataagatccctgcttatcatgcagggatttttatgaggtatagggatcttaagtagatttatatgtattatttatttctaattacatagataatctagtttttatctgttctatattccccctaaagtaaccgcttcagaaattagaatagcggtttttatacagccttaatttatctattttgtgaagtcgatcacagatttgataaaaggattaaggcattttagagtattattgactataatactctccctttttttatatcaatgaggatacttgttatgatgaacagaggacgttttcttcaaattggtgcgaccactgtattagccattagtgcaaatcgctttgcatttgcagctggtgatagcaaagtttcttacgtgtcattggcacaacggatattcacagttttttaacggattttgactattataaagatgcgccaacaacaaaatttggttttactcgtgccgcaacgttaattgaacaagctcgaaaagaagcttaaaatagtgtacttgttgataatggtgacttaattcaaggtaatccgattgcggattatcaagctgcggtcggttataaagagggtaaatctaaccctgcgattgatgcgttaaaccaggtactgatgagccagtttaccaaccatacttcattcagaaaaaagaagtggttgatgaagatggcgtgaaacatactttaaatgtcggttatatcggtttcgttccaccacaagtaatggtttgggataaagcccatttagacggcaaagtggaagctcgtgatattgtgaaaacggctgaaaaatatgtgccaatcgtgaaaaaagcggggcggatttaatcgtagcacttgctcacactggcccatctgatgagccttattttgaaacgtcgccaagcgataaagcgaaagcctttattgtagaaaaagcacaatatccaatgtcattcgttggcactgatgaaacaggctttgcgatttatcagattgatttgacgaagtaatatatttatagccaagcattttaattaagttctttttagaatactgggctctttttttagagttttcatcctacaccccatcttgtatgcttcattttatcgaactcaatcatcaacaataccccacagacgaacacggctatttgaaaaatttagacgactggtcgcctgaacttgccgtagttatcgctcaaaaagataaccttgaacttagcgaagcccattgggaaatcgtctattttgtgcgagaattttatcaagaatacaaaacatcccctgcaatccgaatgctggtaaaagccttgtcacagaaatttggtgaagaaaaaggcagtagccgttatttacaacgtttattccccgaaggcccagcaaaacaggcaaccaaaattgcaggcttgccaaaacctgcgaaatgtttataggaatgaagatgaacagcccacaatcaatctgtattttacgcctttctgcgattggtgatgtttgccatacccttgctgtcgtgcaagccattcaacgccaatatccgcaagctgaaatcacttggattattggtaaaacagagtcgatgttaatgcaaggcattccgaatgtaacccttgtgccttatgataaaaaaacgggatggaaagggattttggcgttatggaaacagcttcgcagtaagcggtttgattatctgttaaatatgcaaacggcattgcgtgcatctattttatcgttaggtattcgagcaaaacagaaagtaggttttaatcaagatcgggcaagagaaggacagtggctatttacaaataaaaaggtggaacagaccgcttccccccacgttttagacggtcaaatgatgtttgctaaagcgattggtgtgcaagatctacgcccaacttgggatttacctgtaagtgaagcagatttagcctatacgtcgcaatttattgataaacaaagaaaaaatttagtcattgtcccttgttctagcaaaaaagagaaagattggtcgcctgaaaattatgggcaaattgcacagtttgcattagcacaaaacatcaatgtgattattgcaggctctccatcggtttatgagatggaagtagcagcaaaaattcaacaacttgcaccgaattgccttaatcttgcaggaaaaaccaatttaaaacaacttgcggcattaattcgtcaagcggatttggtgctatcttcggattcggggccagctcatattgcgacaactcaaaatacaacggtgattggtctatatgcgattcataacccacgccgtacaggcccttatttagatttagataaagtggtgtctgtttatgatcaggttgtattagaaagtcgtggaaaaccttgggatcagttgccttgggcgacaagtgcgaaaggtgatggactgatggagagaatttcagtagagcaggtgaaacagaaaattcaagattatttataaaatcattgtttgggcggaccgatgtgtccgcccgaaatattatagggctttgacagcttgatagattaaactcaaaaaaccattgaaactttgccaattacgttgtaaattacctctgtattgatttttttacaattataggaaataaaaatgaacactgtatttaatcaggatagtttacacaacgtaaacatttgtaatgaaaaagttttgctaacgccaaagggattaaaacaagagtttccgttgccggagcatctgcgtaaacagattgaagaatcaagaaaagtgatctcagatattattcataaacgtgataaacgccagcttattgttatcggcccttgttccattcacgatcctgtatctgcattagaatatgccaaaaaattaaaagtgttagctgacaaagtgtcagataaactttacattgtaatgcgagtgtactttgaaaaaccacgaactacggtgggttggaaaggcttaattaatgacccacatttaaacggcaccttcgatgttgaaaaagggttacgcattgcacgtaaattattgttggatttagctgaactgggcttgccacttgcaaccgaagccttagatccgattagcccacaatatcttgctgatctgtttagttggtcagcgattggagcaagaacaacggaatctcaaacccacagagaaatggcatctggcttatcaatggcggtgggatttaaaaacggcacggacggaaatttgggcgtggcgattaatgcaatgcaggcttctgcaatggggcatagttttattggcattaaccaacaggggcaagtgacggtattgcaaaccaaaggcaatcctgatggacacgttattttacgtggtggaaaatccccgaattttgaagcacaatatgtgcaagagtgcgagcaagcattacgcaaagccggcttgcctgaagcgattatgatcgactgtagccacggcaactctaataaagattaccgccgtcagccgttggtggcggaaaatgtgctacaacagattgtcgcaggcaatcaatctattatcggcttaatgatcgaaagccacctgtttgcaggcaatcaatcatccgagcaaccttttgaacagatgaaatatggcgtatctattacagatgcttgtattgattggcagacaacggaaaccttattaaccgattttgcagagaccctaagaaagtagtatgaacccattaaatcctattcgtgaacagatcgatcaagtcgatcaacagttaattgaattattgtcaaaacgtctttcactggtggcagaagttggcaaaattaagcaccagcacggtttgccgatttatgcccctgaacgtgaagcctcaatgattgccgctcgccgtcaagaagcagaaagtcagggcattcctgctgatttgattgaagatgtgttgcgtcgtctaatgcgggaatcttatgccaacgagaataaacacggctttaaagcgacaaatgagcaaatgcggaaaatcgtggttgttggtggcttgggcaagttaggcggactgtttgcccgctattttgaattatcgggctactcggtcgaacgccttgatcgagatgactgggagcaagccgaacagattatgcacggagcggatttagtggtggtttgtgtgccgatagccaacaccttagacacccttgagcgtttacagccgtatttgaacgaacagatgatcttagctgatctcacctcagtcaaagcacagccgttagcgaagatgttagaagtgcattccggagccgtcgtcgggcttcatccaatgtttgggcctgatattgcaagttttgccaaacaagtgatcgcttgttgtcacgggcgttttgccgaacgttatcaatggttgcttgaccaaatgcggatttggggagcgaagattgaagagatcgatgccacagaacacgatcacgcaatgacctacattcaagcactacgccacttttccacctttgcttatggcttacatttatcgcaacaagcggtcaaattaccacaattacttgcactttcgtcaccgatttatcgtttagagctggcgatgatcggtcgtctatttgcccaagatgcgaaattgtatgcggaaattattgccgataagcctgaaaatttagatgtcattgcctcgctacaacagagttttgaaaagagcttggcattctttcagcaaaacgataaacagggctttattgatgcctttgaaaaagtgcattgttggtttggcgattattccgaacagttccttaaagagagccgtaatttattgcaacaggcgaatgatttgagggggtaggaatttactttactaagacattttatattttctcttgcttttccgcccttaataagggcggagtctatgagaataattatgtatgccgagcttacttcaactctctcgctcctaaattatccaccttacaaatatggataaaaccctcattattttgtagataatctttttcaagataatcgaccagtttttgagcgtgttctaaatctggtgcaatggcgaacatagttgggcctgaccccgaaatacccaccgctaacgcccccaaatctttacaaccttggcggacttcggcaaagtttggcagtaatgattcacgatacggctcagcaataagatctttcatcataattgcggcaagtacatcttgacgagtgtgacaagcgtgaacgaaagagcctaaatagcgagcttgtgagatcatctcttggcgtgtatagcttttcggcaagatcgcacgggcttctgcggtggaaacttcaatcccaggataagccagcacccaataccattcgtcaaaaaacggaatcggctggcagatattgccgagagattgagtcatcagttgcaaaccgcctaaatagcaaggtgcaacgttgtcgtaatggattgagccagaaattctaccttctagttcgcccatcatttccaacaattccatttttgaaaacggttcatcgtggaatttattcagcgctacgagtgcagccacaattgagcaagcacttgagcctaagcccgatccaatcggcatatttttctcaagggttaggcgtagatttttcactacaccaccacgcaatttcaagcgttcgctaaacagtacataagcttgatagacgatatttttttgcggttctttcggcagtttacgcacaaaataaccgacactttccaactcaaacggttgatcacactcttcaatttgtactacatcgccgagtaatgagccatcaatcggcgaaatggctgtgccaagagagtcaaacccgacacttaaatttgcacttgaagctggagcataaattcgtaatgtcatttttttcctttgtttttataaccatttttgtggggacgccacgcttggcatccgttataagcggttagtttggaacaaaattttgcaaatgtagatttaattcagtgtacgcaaaatatccgcaaaaatacccgctgccgtcacatcattacccgcaccgtagccacgcagtaacagtgggatcgggctgtaataacgggtatagaacgcaagggcattttcaccatttttcactttataaagtggatcatcaccgtttacttctttgattgcgacacggcatttaccgttttcaatggagcccacataacgcaacacattgccacaagcggtcgcgttttccacacgttttgcaaattccacatcaatctccggcaacatcgctaaaaattctgctgcagttttgccttcagagaaaccttttggtaaaacaccttccacttcaatatcttccagctctaatggatagccacattcacgggctaaaatcagcaatttacgagccacatcttgccctgataaatcatcacgtggatcaggttctgtgaagcctttttctttagcaatggtggttgcttcagacaaacttgaaccttcttctaatttaccgaaaataaaagaaagcgaaccagataaaatcccttcaaatttctcgacttcatcgccggcagcaagcaaattttgtaggttttcgattacaggcaagcctgcgcccacattggtttcatataagaatttatgttggctttgacgagcattttcacgcatttcctgataataagcatagcttgaggtattcgctttcttatttggtgtaatcacgtggaagccttcttttaatgcacgagaataaagatttgccaccgattgtgctgtcgtgcaatcgacaaaaacaggattaacaacgtgatgtaatttaatgaatgaaagcaacacatcaaagtcagatggctgtgtcgccgactctaaatccgcacgccagttatcaaggcttaagccgttttcgttgagcaacattttatttgagttagctaatgcacaaacacggatctcaatatccttctttgcaagatattccttctgggttgtgatctgttcgatcaattcgccacccacaccgccaacacccactaaaaagacatcgaccacttttttgttattgaataacgctttatgtgtagctttaaccgcttcaatcgctttatttaacggcacaaccgcagaaatggaacgttctgatgaaccttgtgcaatcgccacaatgctgatatttgcttgagccagtgcagagaagaagcgagccgcaatccctttggcggtacgcataccgtcaccaaccacagaaataattgagagatctttgatcacttccacaggatcaagcgagccatcttttaactcttgagcaaaagtattgtttaacgcacagagtgctttttcgaccgcttttacaggcacacagaaactaatactatattcagaagaagattgtgtaattaagttcacggaaatacccgcttgcgacatcgaagtaaacacacgagcagccataccaaccataccttgcatacctgagcctgaaacattgaacattgccacattatcaaggttcgtgatccctttcacttttaaattatcattgactacattactgtcaatgattgtgcctggtgcttccggattatgggtatttttaattaagcatggaatgtttaacggtactaacggaccaatagtgcgagggtggatcactttcgcaccgaagtaagaaagctccatcgcttcttgatagctcatagactctaaacagatcgcatctggtactaaacgaggatcgcaagtataaacaccatccacatccgtccaaatttcgcacacattcgcttttaagcaagcggctaaacaggcagcagagtagtctgaaccattacgaccaagtaacaccaattcaccttgttcgttacctgccgtaaagcccgccattaacacgacgtttttctttggaatagaaagagcttcaatacgtttggtcgattcagcaatatccacagaagattctaaatagctcccgtgtgctaataatttttcgataggatcaatgcgagtaacttcataacctttcgcttcaaaccacgctttcatcatcgcaatcgacaatttttccccacggctatgcactgttgcaccgatattatctgggcagaatttattttttgctgcttcagctgcaatattgcagatgtcgtctagttctgctttgataaaggcacttaatccttcacggtcgaaattgttattgacggcatataatccgttgatgatgttattgaaaatgtcggtggcttcggtgagatgagattcgtaggattcgcctgtttgggctttatcgacaatagcgacaagatggttagtgattttagctggggcggatagtacgcctgcggcttggtctgccaaatgtgccttttcgatgatgtcagcggcttgtaaaaagcgttctggattggctaaagaagtgcctccaaattttagaactcgcataatttctcctgaagataatagttaatgtttgcaaattttgttacaaaaaaacccgcttgttaaagcgggtttcgttgaatattgttccgttttctagccacgaacacccgcactatgtttgcacataatggtcatcgtcgtggtaataatcatagaaaaacggttcatcgctattctctaaatgttaagcatgaaagacaagtgggagaatcctctaaaatagaacatttgtcaacaggtttttatagaataactactatttaatatgtcagattaaaaatcgatgtatctatattctttagaacaacatcttatatggatacatttttgctattgatacagaatgtatgctcgaatattttaattcctcaataagagagcatgaacaaattaacgaataatgccacgcgtagaacgtttaaagaaatccaagaataaactgaccgctgcttctgtttttgcatactgttcaatttctggaatagcttcttctaaggttttaccactgcggtaaattagcttatacacattgcggattgcatgcattgtcgctttctcaaaaccacgacgttttagcccttcaagattaaccccgaacggttgtgcgtggttgccttgagccattatataaggcggcacatcttggctaaccattgagccaccacccaacataacgtgcgaacccacaacgacaaattgatgaatagctgacattccgccaacaatcacaaaatcatcaagagtaacgtgtcctgctaaagtgccattattcgcaataatacagcgattaccgatagagcaatcgtgggcgatatggcagttaatcataaataagttatcgttacctacacgcgtaacaccaccgccttgaaccgtaccacgatgaatagtcacactttcacggatacggttacgatgtccaataatggttttagttggttcaccttgatatttaagatcttggttaatttcaccaatacttgcaaattggaaaatttgattatcttcaccaatttctgtatcaccttgaataacaacgtgagagtgaatttttgtaccagccccaatgcgaacatctttgccgataacacaaaatgcaccgatttctacatttgcaccaattttagcaccttcttcgatcaaggctgttgggtgaattttggctgaagcgtcaattaatggcatagtattttcctctttattcaagcaagattatttacgtgcacacattaggtctgcttcgcaaactagcttatcatctacataaactttacctgtaaatgccgtaatgcctcgacgctctttaacaaaggtcacttcaataatcatttggtcacctggtactacagggcgtttaaaacgtgcattatctacagccgcaaaatagtaaagttcattgtctttcaatttgccgtagcttttaattgctaaaacccctgttgcctgagccattgcttctaaaataagtacacctgggaaaacgggttgatttggaaaatgcccagtaaaacaaggctcatttacactcacattttttacagctcggagccattttccttcttcaaaatcaaccacacgatcaactaataggaatggataacgatgtggaagcatttccataatttcagttacttcaataattcttggttcacgattttctgtttgtaatttggttgtcactactaagacctcaatcaattattcagctaaacgtttttccaatgctttcaaacgtttattcatttcatcaatattcattacaagagcagctgttttacgccattctttattagtttgcaaaggaatacccgatgagtaaattcctttctctgtgattggtcgcattaccattcccattccagtaatgattgccccatcacaaatttccatatgcccattgattacacttgccccaccaatttggcagaagcgtcctactttcaggctaccagccattacgacacctccagcaatcgcagtgccataaccgatatgtacgttatgtgcaatttgacataggttatcaataatcacattgtcttcaatcaccgttggatctaaagcaccacgatcaatacaggtacaagccccaatttcaacacgattaccgataatcacgccaccagtctgaggaattttaatccattgacctttctcatttgcatagccaaaaccgtcactaccaataacggcagaagattgaattaaacaatctgagccgatttgtacattatggtaaaccgacacatttgcccataatttggttcttgcaccaattttactgttttttccgacaaaacagccagcaccaatcaccgcatcatcaccgatttcaacaccactttcaatcacagcatttgcaccgacagaaacgttatgacccaatttagcatcaggtgagatcacggcactttcagcgatattttcggcagggtttggggttgtatccatatattgagctaaaatcgcataagcaacataagggtttccaaccacgatcaagttttgaccttcggcacaaaattcgacatcagcttcagaaacaataatagctcccgcttggcattgagctaactgtggacgatattttgcattagagataaaggtaatttgattagaagttgctttatctaaaggagcaatgcttaaaatagccaaatcggcgttaccctttagagtaccgccgatctgctccgctaattcaattaaacggaattcagccattattttttcacttcttctggttttgtgacttccgctgcaggcacttcagtttttggagcctctggcatttttccacccattgcaactagaatttcttctgtaatatctgctgcatttccatctttagcatataatgcgaccgatggaggaagaactaaagtatagcctttagattccgcgacttgtttaattttcgcattaatatcttcaacgactttttgttgtacttgttcaggagttattacaccagattctttttgtaccttagcaatttcttcttggaaagccgctactttcttttgaaactcatcagcacgtttttggaactcttctgctttttttccaaattctacttcacgttgttgcaatgcagaaactttattttggaatggtttagcttctgcgttaattttatcctgacgtgcttggatctctttcgcttttaacctaggtgcatctttttcaagttgggctacctttttcttcattgcagcttctaaggttacttgttctttttgtaacttctgtgcatcttcttcaatttttttacgctcatccaataatgctttttcttcatcagataatgctttattttctgctgctaattgtttttcccttggtgcaaatttagattcagtgtctttcataaatttagtgaatttatcatttgcttcaatggtaagtggatgattttgtatcaagaaattaggatcaacaaatccaattttttcatttgcatttactgtattcgcactaaaagctaaagctgaagcaactgcggcaagtttaaataaatttttcattaaaatgtcctttctgaagttaggaaagatagactcgtaaaaaaatgaacaaatctatccgcttgtttataagattagaatgaaccaccaatgctaaattggaactgttcaatttcatcaccttgatattttttaattggtttcgcataagaaaataccaatggacctatcggggaattccattggaatgcgatacctgtagatgcacgaaaacgtttataatctttaaagttttctaaactagaataattatattgaatgtcgtttactactggattagttttccattttgtattcaacactgttgcagcgtccacaaataatgaagttcttacattatgttgatatttttcacttacaaatggtgttggagtaattaattctaaagttgcagatgccattgcattaccgccaacaatatctctatttacggaattgaatccgatattaccattgttatctttacccagatagattgcttttggtccaatagctccataagcaaaacctctcagagagccgatacctcctgcagtataagtttgatagaatggtaattctttaccactaaaaccatttgcataagcaatattcgctttagttgagataacccacttatgttcgcgattgactggtaaatagtttttaaaatcaatactaactttataatacttattgtctgaacctggtgtggtaatacgtccactaatgcttgtcaaagtcccttctgttgggagaaaacctcgatttagactattatagttccaaccaaaagaaaaatcgaagtcatttgctttaatttttttatagacatttaagtcattatcaatcgggaatttcatggattgtacataaagttcacgattaaattcacgtcgagcattcttaatcagatcttgagtgtagcctagaccaaggaaataggagttgtattcatttacagggaatcctaaagtactattgactccataggtttgtcgtttataacttgcgacactattattttttgaattatcataatcctcgtagaagatatttccaccaaggcttactccatccttagtaaagtatggttcagtataccctaaattgatacttgtaccatagtcattacgggtaccatttaaactaattgtagagcccatacctaagaaattatcctgttttatcccagcttgataacttaaaccactttctgttccataaccaacaccgaaattaatacttcctgtattgcgttcttttattttatatacaatatcaacttgatccgccgtatttgggacatttggatagctcatttctacactatcgtaaaaccccgttctttctagacgagccttccccaaagcagctagacttgttgacaaccatgctccttcttgctgacgcatttctcgacgtaacgttgaatctgcagtcacatcatttccttcaaaacgaatctgtcttacataaacacgttgtccagcatccacaacaaatgtgagacgaattgttttatttgtatcatcgaaggttggatgaagctctattttagcggaagcaaaaccattatttccaaatacttgtttaatattgtcttcaatttttgaaagttcatttttgctaaagagctcgcctgttttataatatttgagctgttcatttaactcgttgtctaattttgcagtattaccaacaatacgtatttcacttacagtataaggtattccttcattgattttatatgttaaagatacttcttttttatcatcactaaatacgggttgttcagcttcaacattaaattttgcatatccttggttcatgtagaaattacgtagattttctaaatcttgattgtatgctgtttgttcaaatttactactttgaaaaatattgaaccaagaaacatcaggttgaatatccagttgtttcattaatacttttgatgtaaaagcttgatttccttcaaaattaatagcttttacataggcaacatctccctcttttatatctaatttaatatttacacctccattgtctgagtttgttataacagtatcaatggtagcattgtaacgacctatagagtggtaatgctcaataagtgctgatttaaatgcgtctaactttgtagaattaaataattctcctttagtgatgagattcgcttttagattttgttccagtggctccttggggattgcagaattaccttcaatatcaacattattgatgactggattctctaccactttaataattaaaatatctccttcacgggttgcactaatattttgaaaacgattttgtacaaataaatgacgaataacgtttgcaatatcattatcagtcgctagttgccctacttttacaggtaatgtagggatcattgtttggcttacagatgtttggataccatcaatacgaatatctttgatcacaaaaggtgaagcaaaagcaacaccatttgcaactaataatgttgaaagtaatagttttttcatttaaatgatcctattcgttggtaaaataatattgaaatctaaccacttgattataaatggactaaatcattaaataatgcaaataacatcaaacctataacaaacattgcaccaatctgttgaaatcgcaattgaaatagttcagaaataggtttctttctcattgcttcccctgctagtaaaatcaactgtcctccatctaaaggcaaaatagggaacaggttcatcactgcaaggttcacacttatcaatgccataaatcctaagtaatagacaaaaccaatttcagccgttgccccagccccttttgccattgaaattggcccgcccatattactaagagaaagctcgcctgtaattaaatttccaataaattgtaaaatcgtataacttaatgatacgactttttctaagctctttccaagcgcagaaagaatatcatactttaattcactttgatactttgattctaatggttgatacgttggcactaagcctattaaataacgttcctcttttttagaatattcaggttctaatttaaaaacaagttgttgattatttctttctaccactaattcaatagttgttcccgattgaacctgtttaagcaatccttgccattcaaaaggttgctgatttaccgaaataactctatcgccagctaaaatcccggctcttgccgaaactgaattttcgactacatttttaataattggttcaaccgttgcactttttggacgaattcctaatgaagtcaaaggattctctttatttccattaacgttccaatggcttaaatcaagtgaaaactgacgcgggaagtcttcattgactaaacttccctctacactaatttccttagttccaattttgccaagcaaagctaacgtgacatcttcccaatcttgcacatcacgcccatcaacacgtttaatctcaaattcagaaaccaagtgagcttgttgagcaatagaattcggaatcacagaaccaataacaggctttaccattggaattccaataacaaaaaccgcccaatacgccaaaatagcaaataaaaaattcgccactgggcctgcaagaacgataaaagcacgctgcaaaacagtctttgtatgcaaagattgcgaatctggcaattgatgttctgcttcgccattgtgcatttgcacataaccgcctaaaggaattaatgaaaatgcaaattcagtcccttgtttatctttcttacgccataatacttttccaaaaccgatagaaaaacgcaaaacttttacgccacatttacgagcagcccaaaagtgtccatattcgtgaacaaacaccaagacgcaaattaaaataaaaaaggcaaagattgatagcacaaataacctctatagaaggaagaagaaaccagtagcaaaaacaggaacagccgctgttaagctatcaatacgatccaaaattcctccgtgtcctggaatcaaattactgctatctttaataccagcttggcgtttaaacatactttcacttaaatcacccaaaatcgaaacagccacagtaatcacggaaagcacgataaacgcagatgtattcaactcacgaccaaatacattgtttggtgcaagactcaagaaaatagcggcaataatagtcgatgtaatcacaccactaatagccccttcccaagatttacctcgagaaactttaggtgcaagtttatgtttaccaaatgcacgacctacaaaataggcgcctgagtccgctccccagaccaataaaaacacatagagaagtaaataagttccctgatattgttcaagattatattgataaaaacgtaacgctaaagtaccgattaaaaatgggacgagtgtacaaaaaccaaaaataaatttggctgctactgacttactccaaattgaagctgaattaggataagtaataaccaatccaaatgcgatgaaccaccaaaaacaacctacaaataatagtggtattgtttcatctgttaaaaaacgtgtagcttgaatataacttgtttctgccataataggaaaaatcaataaacaggtcaccacaaaagcaacaatagcacgtgctatcggacgtttaaaacccgcaaactgagcccattcccacatacctaacacaacaatagcggataagccaatcgtaaaagctaagggtgaaagccaaaacaatgcaaccactgctaaaataatcatcacgattgccgaaagaatgcgttctttaagcattgaattttccttatagattaacaaccaccaaaacggcgatcacgttgttgataagcaataacggcatctgtaaatgccttttcatcaaaatctggccataaaaccggactaaatactaactcggcataagcaatttgccataataaaaaattgctaattcgctgttctccactagtacgaattaataaatcgacctgtggttgatccttagtagataaattgtgctggaaataatcagttgtaatatcttcgataggtatgacattattttttacttgatgtgcaatacgtttggttgcttggactatatcccattgtccgccatagtttgcagcaatgtttaaagtcaatgcagtgtttttatttgtcagttgttcagccagttcaattttttcttgcagtgcttcactaaaagcagttttatcaccaataatttttaagcgaatattattgctgtgtagtttttttatatttaaatccaatgtttctataaatagtgtcattaatgcggcaacttccaacttcggtctagaccaattctcactgctaaatgcgtatagcgttaataccttaattccttgcgttaaggcaaaattaacagctgaatgaacagcttttaccccttttctgtgaccaaatactcgtaatttccctcgttgcttagcccaacgtccattaccatccataataatcgccacatgctgaggcatattttgaagatctatattcacagcaacttacctatttgaacaataaacatgaaaacgtttttaactatatcatatgatgagagataggggaaattaagaatgatgtgctagataggatttagcttatatgtattaaaaattatcttttttctgccttaatataataaattcatctaaagtcaccgcttgcataaatggattaatctgtttttcaacaccaatcgtactcggtagcgttggtttatgttgtgaacgcaaaatatccgctcgctcttgatgttccattaaactacagcttgttgccattaccgcttcggcaaatttcaaattgctttgagtatattcgtgaccagcatagactttcacaaaatcaggcaaggctttaaaacgttgtagggcatcaaactgagcttggtaatcccctgtaaacactctcccacaaccgcctgaaaataacgcatcaccacaaaagagatattcattatcaaccaaatagctaatatgttgcgccgtatgccctgcactctcaatcactcgcacctttaaccctaacagttcaaactgttgctcagggtaaacaatctgattggcaaattggctcacttcttctgagccataaataagcatatcgggaaattgtgccactaaaccagccacgccatcagtatgatcgtgatgattatgggtaagcaaaatagcggtgggattaagctgatgttttgcaagaaaagcgaatacagcttgagcctctgctggatcgacaataatcgcttggcactctttttgtaaaatccaaatgtaattatcagaaagggctggaattggggtgatttgaagcatatttattttccgtaggtcgggcatttatgcccgacattgccgtgttttatgaaaaattgtcgggcataaatgcctgctttgccatattttatgaaaaattgtcgggtataaatgcctaactttgcggtattttataaatgattgtcgggcataaatgcccgacctactatttcaagaataacgctgccgccccacgcacaccgcttgagtcaccgtggatcgcttttttaatcactggcacttccgtattacgcaataaatattttggtaaggcttttggcaagacttcataaatataatcaaagttagacaaaccaccaccaaacacaatcatatctggatcaagtaccgtaatataatttgccaccgaaattgccattaactcaatgtatttctcaacaaactcaacggttttctcatctttatcgtaaaaacgctgaataatgttttttgcatcaactttttcgccgactaaatcattataaagcatctcaaaaccacgtcctgagatatagctatccaaacaagccatattaccacagccacatttataaatcggtgccttatcccaaccaagcaatttcaacgcgtgatagttaagctgaatatgccccacttcgccagccataccgatttgacctgagtgagctttaccgttcaacacaataccgccaccaaaacctgtaccaataatcaaccctaacaccgttgaatattgcagattgctttcgtcccacgcttccgataaagccaagcagttcgcatcgttttcaacacgcacttcacgccctaaacgcgcttccaaatcttgaataattttattgccgtgaaccaccgcaatgttggcaatttccgctaacccagttttatgattaacaaaacctggtacaccaagccccacagtgccgtgctcgccaaattttgcatcggcattacgcactaaggtttccactgttcttaaccaatcctcataactcgtttgtggggttggcactcgctcgctgtgtaacttctctaatttctcattaaaggcagccaattcaatttttgtaccgccaatatccaaaccgtaataaaccatagttagcctcgctttttaaataatgtccatttttctaagagtgggattacccataagaagatgatcaagtggaaaacccacgcaatcaaagtactgacaaacagatcgataggataatgcattcctaaccgcaaacggctgatcaacatcaaaccagcccacaaaatcacaaaaaattgagcaaaaatcaccgcttgtccacgaataccaaacagcaaccctgcaaacatcaatagccaagataccccaaaaatcgtatgccctgacgggaaagagtagcccagctcatctgcttgatgttcaatcacaaactgattttcaggttgcacaaatttcaataccgccgtttcctgttcagctttaggtaaagcataaaatgcctcagtatccgcctgaaacatctgtgtcacaaaaggacgaggctctttaaagaccgctttcgccccctctttaattgcctgtgttccaactaccgacgttgcacaaataaagcctactaaaaaccacgaatagcgagtgcgcgcaagccacatcagccacaacataaacagcacgcaagtgattaacgcataaggcgttgaacccgtttccgttaaaataaacaacgcccaatcgaaaacattaacaccaagattagtttgcaaattccattgccacccaattaaccacgctgtagctggaatgaacaacattaataacgtcaaaaatgaaagtttctttaccatattataaatcctatgcaatattaaattgtattcattaaaaaactacgtgatatacctgtaaaataaatagaatgtttctgtaatataatgaataattagcacctgcttactaaaaggtagagtcccaccacccctactgattgttatgtgctaccctccccaatggtttcttattgctgacttctaattaagctcaacagatatatcctagtctgtttattctaatttcgactaccacattatgactattgtgaagaaaatctaaggcgcagaagtaaaatatgaaaaagaaattactccattaaccctgccattgcctgagctttgcggtcaatttcttgccattctgattgaggatcagatttttcgacaattcctgcccctgcgtaaaaggtgatttgattagcttgaataagggctgaacgtaacattacgcaaaactcggcttgttcaggggtgaaatagcctaatgcccctgcataccagccccgctcaaaacattcctgttgttgaataaactgcttcgccttagggcgtggcagtcctgcgacggcggcggttgggtgaatacgagcaaggcaatctgcgtcgctgacctgctctgtcagttgcgtttggatttttcggcgtaaatgctgcacgttatgtaaccgtttgatctctgcatcgctgacttgaatatccgttgcacaatccgccagatgactacaaatatcgtccacgaccagccaattttcatagatatttttttgatcgttgagtagccatagggcattttgttccgtttgaacaggatcgtccgtcaccgccactgtgcctgcaagggcttcggtaaaaaattgacgttgctggcgtaagtagagccgttcgggtgtcgagccgataaaggcttccccttgtttttccgaccataagaaatgataacagcctagatttttttgttggctggcaaaaagcagaacgtaaggggaaatgtggtgtgtaaaagttttgatggtcgcattggctaacaccactttattcatttgctgttgttgaatttgttctatcgctaattcaatgttgtgttgccaacgtgaaaaatcacaggcaacttttgtgcttaacaagctattttcaatggggtgaagttcggctgtctgctcaaactgagctaacaaagcgatacattccttttgttcgctttcaaaatggcgaccatctagatttaaccaagcggtgattttcttctcattttttactaacagtaagcgtggcaacacaaaatggcattgtccttcaaattctattccgccgacgaccattaaatcagactgtttgctaaattgttctacatcgtctaaatgctcaaaggtttgtaccgcaccgactgccactatcgtttgttctgtatctcgattttgccagtagtagtgggggaaaagcggttgtgcttttagccaagctagtaattgttgattttcaaggtctattgcaatttctgcttgcaactgtactaagccttgtgccacaggcttttgttgtagttgttgataaagttgttgctttaactgactaaacacagacattgcaaaaaatcctaaaaatctcaccgcttgaccagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatgtcgggggcaaacagctggactgaaatcaaactttttggcgaattacatttggattggttgcgaaaatatcgtccttttgagtgtggtattcctgtcgatgatactatcgctcgtgtaataaaacgcattgagcctcaagcgtttaatgaggtttttcttaattttatcaatgagatacgcacacaacaaggacgtgaagtgattgcgattgatggcaagacacttcgtcatagtttcaatccggaaacccaaagtgctttgcacagtgtgactgtgtggagccagtctcgtggtttgattttatcgcagaaaaaatcctcgggtaagcaaaatgagcagcaggcggtgatggaaattatcgatagtttttgcttaaaaaatgccgttgtaacggtggatgcgatgaatacacagaagaaaattgccgagaaaatcatcgaaaagaaaggggattatgtgatgccgttgaagaaaaatcaccgtcaatttcagtcggaagtggaggcgtattttcacaaaatcagccgagattgccccgaaatgcttgagacgtttgaggaggtaaatgcggaacgtcgtcgaattgatgagcgttactaccgtaagctgaaagtgagtgattggctgagcaaagcggaggaatggaaggggataaaatcggtgttggaggtgtgtcgcaagcggtcagataatggcaaagaatcgcaagaaaaagtcttttatatcagtagtttggatgttgatattcaaatattggcgaagtgcgtgcgagggcattgggaagtggaaaacaaagcccattgggtgctagatgtggtctataaagaagacgaatgtgctgtgaccgatgaatggggtgcggaaaatctggcaatcttgcgtcgattagcgttgaacttggcacgattacacccgaaaaagcagagtatgaaagggaaattgaccgctgctggttggtcagatgaatttcgagatgagctgttgctcggcgtgtaggttgaaaaatggacaacatatgcggttgccctgaccgcttgacaaaaagaagtctattttagcctatttccacttttttttcctaacaaatcggagtacagtagagtgatttttataaattaacagataattaaccctctattttagggagaaacaatggaacgttttgcaaaaaccgataaattagctcacgtccgctacgatattcgtgggcctatacataaggaagcgacccgtctggaagaagaaggacataagattttaaaattaaacattggtaacccagccccattcggttttgaagcccctgcggaaattttagttgatgttattcgtaacttaccaaccgctcaaggctattgcgactctaagggtttgtactctgctcgtaaggcgattgtgcaatattatcaattaaaaggtatgcgtgatttagatgtcggtgatgtttacattggtaacggcgtatctgaactcatcacaatgtcaatgcaagccttgttaaatgatggcgatgagattttaattccgatgccagattatccactttggacagcggcggcaacccttgcaggcggtaaagcggttcattacctttgcgatgaagaaaatgagtggtttccagatattgaagatattaaatcgaaaatcaccccaagaaccaaagcaattttggtgattaacccgaataacccaacgggagcagtgtatagccgtcagttattattggatattgtggcgattgcccgtgaacataacttgattattttctcagacgaaatttacgagaaaattgtctatgacggtgcggtacatcatcatcttgcccctcttgcccctgatcttttaacggtgacttataatggtttgtcaaaggcataccgtgtggcaggtttccgtcaaggttggatggtgttaaacggcccgaaaaatcaggcaaaaggctttattgaaggcttagatatgcttgcgtcaatgcgtttatgtgccaacaccccgatgcaacacgctattcaaacagcgttaggcggttatcaaagcattaacgaatttatcttaccgggtggtcgtttattggaacaacgtaataaggctcacgaattgctcaccaaaatccctgggattagctgtgtgaagccaaaaggggcgatgtatatgttcccgaaaattgatacggaaatgtacggtatcaaagacgatcaaaaatttgtttacgatctgcttcaacaggaaaaagtgttgctggttcaaggctcaggctttaactggcataaaccagaccacttccgtgtggtgacattgccgtatgtggatcaactggaagaagctattggtcgattagcgaaattcttacagagttatcgtcaagattaattaagcatttccatttaaaatatatgggacacactgtgtgcgtccaaaaatctattatgtaacattgtagggacgccacgcttggcgtccgtccgtgaacataaatcgcacttcgtctttgcaatggacgccaagcgtggcgtccctacttttataacacagatgttcatataggttataggttcattttttaatgataaaaggcatcacattttccgtcaccgcctctattttattcggtgtactctattatttatccacccatttaaaaccgctttctggtgaagaaatctacggttttagaatgtgggtaagcctgccttttgtgatttctgcactctttattttcaaaaaaaacgacgaatttaaccgctatttaaaacgcctaaaacagcacccccatttaattttggtattattaacaactactgcggtcacaggctcgcagatgtggctttttctgtatgccccaaacaacggttatgccattgatgtgtctattggttatctgttaatgccgattgcaatggttgccgttgggcgatttttatttaatgaaaccttatctctcttaaaaattatctcaattatttccgcatctgttggagtattcattacgttaatgaccgcaggctcactctcttgggcaactttaatggtattaatcggctaccctgtttatttcagtttgcgtaaacattttgatatgtcgcatttatccagctttgtctgcgaaattatattaatgctgccgatagccacttattttatgctcaataccgatatgcaatttgtcgccgaaaataatccgaatttttatttttggttagtgttattaggcattgtcagtggtacggcattaattggctatataatggcaagtagccttgtgccgattaatgttttgggattattaagctatattgaaccgcttgcaatgctaattgttgcctttattattggcgaagtgttagatcaatcttcctatattttaatggtgtgtttgatgctgtcgatatgtctattagtgcttgatggcattattgctattcgtaaacagcaccagggggaataatgttaaaagggatcttattttcactttctgcaaatatcttattcggtgctggctattattttgcggttttacttcgccctttagaaagcgatagtatttttggctttcgtattgtggtattaatgccatttattttactggtgatctttttatttcatcaacaaaaagcctttaaagatttatattatagagtaaaacagacaccttatcttatttttattcttctgctcttagcattaaatacagctattcagctttggttatttctttgggcaccgaataataatcaagctattgaagtttctatcggttatctattattacctatcgttgcagttgccttaggcaaactggtttttaaagagcattttactttattaaaatggcttgctttattttttgcaactcttggcgttacaatcaatattgttttaaccgcaagtatttcgtgggcaacttttgtggctggctttggctaccctatttatattgtattacgtcgctattttcatattaataatttagctactttctttgtagaattattattgttattaccctttgctatttattatattgctcaagttgatcaagcctctattttaatgcaaaatgaatatctctatttttatctagcattattagggctggtgaatggaatggcatttattttatatatcgcttcaagtaatttactgccgattaatgtgttaggattacttggctatgccgaacctttggtaatgttatttatttcctttgccattggtgaagtattagaagcaaaatcctatattttaatggcgtgtttggcggtatctattatcttattaagtgttgatagttttcgcaaagtgaagccctgatgaacctcatccaaattgcgctacccgtgccgttggcacgttattttgattacctgcttccaacgcattttgaaaatgtggtgaaaggggctagggtcgttgtgccttttggtcgccaacgtaaaatcgggattgtggtggactttccgaccacatcagatattcccaccgaaaaactgaaaccgattgagcaactgttagatgaacaagctctgtttgacactgaaatgtggcaatttttacagtgggcaagccgttattatcacgcccctttcggcgaagtgctacaaagtgccttgcctgtcaaattgcgacaaggggaaagtagcgaacgcaccacctcagactatttcgttgtcacggaaaacggcagaaaagcacttgccaacggcgtggttcaaaaagcgaaaaaacaacaagagctattaagcgaactggcggaatttgcaaatttctttgaaaagccgaccgcttgtagccctgcggtttggaaagccttgcttgaaaaagggtatctggaaaagctggaaatcccttttaacgtgcaaagctggcaggaaaaattaggcgaacagccgatttgcaacactcaaaaccgtttaacgttgaataaacagcagacccttgtcgtcagccgtttgcattatcaacaaggcttcggagcgtttttgctcaatggggtcactggctcagggaaaacggaagtctatctgcaagtgatcgaagaagtgctgaaacggggcgagcaagtgttggtgttagtgcctgaaatcgggctgaccccacaaactattcaacgtttccaagctcgttttaatgtggaaattgacgcattgcattcccatctcaacgacactcaacggctcaatgcgtggcttcgggcaaaaaacggcgaaagtgcgattgtgatcggcacacgttccgccttgttcacacagtttcagcaactcggcttaattatcattgatgaagaacacgacggctcgttcaaacagcaagacggctggcgttatcacgcacgagatctggcagtgcttcgagcgaaaaataacaacattcctatcattctcggctcggcaacgcctagttttgaaagtttgcaaaatgtacaaaacggtaaatttatcgaacttcagcttactgcaagggctggtaatgcacatttttccaaacaaaccttaattgatttgaaaaaacagcggatttattcgggcttatcggaaaagttgttagcaatgatgcaagctcacttggaaaaaggcaatcaagtgatgttgtttttaaaccgacgggggtttgcccctgttttactttgccacgaatgtggctggattgccgattgcccgtcctgtgataagccctttacctatcaccaaaaacagcgagtattgcgttgccatcactgtgcttcgcaaaaagccattccacgtcagtgcggacattgtggctcagtcaatttgattaccacagggatcggcacggaacagctggaacaagtgctggcacagcgttttccgcaatacagcattactcgtattgaccgtgacagcactgcccgtaaaggctcgttggaacaacaccttgccgaaatccaagcaggcaaaagccaaattttgatcggcacacagatgttagccaaaggacaccatttcccgaatgttactttagtggcaatcgtgaatgtggatagtagcctgttttccactgattaccgtgcagaagaacgtttggcacagctttatgtacaagtgtcagggcgagcagggcgggcggaaaagcaaggggaagtagtgctacaaacgcattaccctgatcacccgttactgactagcttactcaacgacggctaccttgcctttgcaagccaagccttagcgatgcgaaaaataatgagcttaccgccgttttcttcgcaagtgcttattcgtgcaacgggtagagatagcgacaaagttgcaaattttctgcaagatttgaccgcttgtttacaacaaattatcggtgaaaatggctggcaaggctttcagctactcggacctttcaacgctccgatggcaaaaaaagcagggcattatcgctggcagttacttattcaacattcggcaagaagtgcgatccaacagttgttagatcgttttgatgagcaaaaagaacagttcctgcgaaacgatattcgattgacggtggatattgatccgcaggagttggggtaggtcattgtgacctttgagcttatttagccattctaaaaactattggttaacaatatttaaccaagtatttatccagcgctttatctcactgttatcaggaagagtgaaacttatagtttgataagttggcaaggtgttaaataaaggatctgccttagtattcacaacaggcttcattacattatagtaagaaataattcgttgcgattctggctgttgtaagaagcctaaaaactgctgagctaatttgagttgtctgctgctctttgtgattgccgctacttccacctgcactaaatgtccttctgcaaaatctgcagcaacgtatttatctgtctgttcgtgccattgatgatataacggagaagtcgtgtaactgagaaccaaatctgcttcgtttttcaaaaatgcaccataagtttcagaccagcctttacccacagtgacggtatgtttggctaaattctgccacgctgattctgcctgcttgccataaacttgatttacccaaaagagcaatcctcgtccaacagtgctggttctaggatcttgataaatcactttaagatcttgacgctccacaagttcttttaaactttttggtggattactgactttttctttgttgtagataaaagcatattcaccaaaatcataaggcaaaaatattttgctttgccattcaagcggtaagttattggcattattttgcagattatgttctacaaataaattcgatttttcagcttcaggcattaagaaatgatcaatgcctaacattacatcggctttagttttattcttttccaagcgaatgcgattgaacattgtcaccccatcttcaaaaggcataaatttcaaattacattggcattgtttttcaaatagcggctcaagttcagcagcaggcccccattttgaagcaaaagaatcataggtatacacggtcaatgtaggttgttcggcatatactgtggcagtagttagggttaaagcagagagagtgaaaaatttgaatttcattgaatattccttctaaaagtaaaaatagaaggatctaaaacaggcgaagataaattgtctgtctcaaatccctacgctgatattagtcagatcaggttctatgggtatttctcagccttgctatacaaagcaccccgatgagaacagaggtattctactataattttgtgctaagatcacttaaaatatggcgaattttaaaagtcgctgagaatcagtacaaaatagaggaaatcctttgaacgaacttattttcactcttgagcctcaagacaatgctcgtcttcaatcgttatgcggttcttttgacgagcatcttacccttattgaaaaaagttttaaccttattgttgcgcgtaatgcatttacctttactattcaagcagttgaagaaaatcattattctgcaacattattaaaaaattgtgcgaaattaattcagcaactttacaacgaaactgctccaattaaaggaaaagtaaaagaactagatttggaagatgttcatttagcgattcaagaaagccgaatgttgttgcaaaatcagtggacaagttcggctcatgaaattgcaattaaaacaaaacgcggcgtaattaaaccacgtggcgaacatcaacaagcctatttacgtaatattctaagtcacgatattagctttggtattgggcctgcaggaacgggaaaaacctttttagctgttgctgcagcagtagagtctcttgagcgccaagagattcgccgtattttgctcactcgtcccgcagtggaagctggtgagaagctcggttttttaccaggggatctagggcaaaaaatcgagccttatcttcgaccactttacgatgcactgtttgaaatgttaggtttcgagaaggcacaaaagctgatggagcgaaatgtgatcgaaatcgcaccgcttgcatatatgcgtgggcgaacactgaatgatgcctttattattttagatgaaagccaaaatacaaccattgaacagatgaagatgtttttaactcgtattggttttaattctaaggcagtaattacgggcgatattactcaggtggatttaccgcgtagccaaaaatctggcttaaaacacgcaatggaagtattaaaagaggttccagagttaagttttaacttttttgacagtaaggatattgttcgccaccctgtcgttgcaaaaattgttcaagcttatgatgtatgggaagcagaagatgaggctaaccgagaaaaaaagaaattagaaaaattaataaaagagcaagataaaatcctagaacaagcagaagaattataaatatacgttataaagtataaccataattttaggtgtaatagacaaaacattctgaattaaatatagaaaagacgacaaatcgtttagagggattatttagtgaacttaagcgaaaattaaataatcacaatgaattaacgaaaaagcgtaacatgttgtttatacagggtttttttaaataaaaagagttgctaacatttagagaaaataaacattagcagaccctatcccaaattctgtgtaaacacccatttcaacttaacggtgatcgtctaggcgatcaccaaaatcaatcataaatcgattcatcgtcagtttccagttctgaatcggcattgtccatttttttgatgcatctttaatcgcaagccaaatcactttgaaaacggaatcatccgtcgggaatacatttcgttttttaatcacgcgacgaatcacgctattaagcgattccacggcattcgtggtataaatcgctttacgaatatcagccggataatcaaaaaatgtggcaatatttgcccagttatcttcccagcctttcgccacaagcgggtattttgcctgccacttttgcgaaagtgcggtcagattttcgcgagcttgtacttccgctggggcctgataaacctgctttaaatctgcggtgacggctttgtaatctttccacgaaacgaatttcaagctgttacgcactaaatgcacaatgcaaagctgaatcttcgttttaggatagactgcattgatggcttctgggaagccttttaaaccgtctacacaggcaataaaaatgtcttttaagcctcgattttgaagctctgtcagcacattcgcccagaacttcacaccttcattttcagcaatccaatcacggtcacgaggcgtctcaatttctatctcaccttcatcacaaatgacggtcttagatgtgtaaccgttacgtgcatttttaccttttttaggctgatattttttaggtttttggcaaattccgctgccaaggcgtgaagttgtttttcgttcataataaaatacctgtgtctgaatgtattatctcagaaacaggtatttacacaaattgtgggagaggctccttatctggtcaagcatctacagaatcatttactaacggttcatataacttaagcttctttggaccaaacgctgaagaaattggcggtaaaatgtcattagatggtaataactacggcttagcaggcactcgcggcgaaatccaaaaataatttgatattgtaggtcgggcatttatgcccgacaccccaatcaataaccatttgtcgggcataaatgcccgacctacattttatgaaaccatctcaattcccttttatttttttactcacaagcccgatacttctggcaaatccttttgctgatcctgttagctttgaacggttgtcacaagcggtcggttttgagcaaaaatttgcaaaaaaatcggcggatctgaccgcttcccctaaaacctctttgccattggcgaatccgcaaagccttgaagctcaaataaaccaagcgattatcgaacaacagtggcagcgtttaccgacattgttacaggcttatcagcaacaatctcattacgatataacccttgttcattatgctttaggggcattttattacgggcagcaacgttatcctgaggcaattgaacattatcaagcggttttagcgcaacagccgacattggcttaccctcgttttgatttaggggtaatgctttacgaaaatcagcaataccgccaagccactgaacagctgacaatgacgaaagcaaatttagacccgtcaatgcaacagctgactgaacgttatttggctagaatggaggaagagcagagttggcaaccggatttcagcctacaatatgtgcgtaccgataatgtaaataatgcgtcatcttcgcctgtggtgaatatcaacggacggcaatttgtcaaagatcaagcctccttaccgcaatcagcagaaggttttcgctatggtattggcgtatcaaaagcccataatttaaccggtaatcactactttaacggttcggttcattacagcggtgtttactactgggataatcaggattacagcgaacaatcgctccgttttagcttgggctatcaatatcgcaatgccaaaatgggcttaggcattacgccttttattgagcaaaattggttgggtagcccacgttatagcagactattcggtgcaaccttacacggttatcgctacttaacgccaaaatggatcgcttcctctcgtttaacgcatagtcaaaaacgttatcacgacagtttaactgcaagccgttatgacggttttaaaaacagtggagctttgacattacgttggcaagcggtcagatcttggcaaatttttgcaagtattgaagccaatcgagagcaaactaaagaaaaagcctcttcttcccataaaattgggggaacgcttggtgttatttaccgttggaaacattggggcagcgaactcagcggaggctatgccaaacgcaattttgaagggaaacattacctttacggctataagcgtgtagataatgaatatcgggcgaattggtcgctgtggaatgagcagtgggcatggaaagggttaatgccgaagctgaattttagttatgtgaaaattcaaagcaatatacctgatttctattcaagaaaaaatggagaatggtttttgacggtggaaaaacggttttaggcttgatttcctaccaccacataatccaacggctcatcccaactctctaacggcaaatattccaactgctgacattgatgagctagcccaacgctgattaactgcttggcttgggcaagggtgcggtcgtaaaaaccgcctcccataccaagccgattgccttgtgtgtcacaggcaaccagtgggacgaagatcatttctaattcattgagtggcaacacatttcgtacatctaatttgggctgtaaaatcccaaaacgatttcgctctagctgtggttccccttgatattggagaaaaagcagttggttggctgaaaaggggtgtagcacaggcagatatatctttttgccttgcttgataagtctatccatcaacgcaagcggtgagatttcaccattaaatggcaaataaaaggcaatatgttgagcggaatagcgttcaatgagtgctaatgattttgggataatatcttgtgccgcaaaggcttgttcatcagcggttaaggctagacgtttggctcgcatctgcttgcgaagttggttgcgttgttcgcttatagaaagtggagaaatattattcataaaaaaagacccgaagtgccgttatcggtggtggtccttgaaccagacggttcaagggagtcgaacattatcgtttttaggcttctcgtaaacgagcctgctcaccaacaatataagagctcaactcaaagtgttttaaatatcggctcagggacgtaactaacaacgcacacctcaggcaaagagaatactaacggaatttgctaatttttcctagtgttcagatcaataaaatcatagaaattcgctttattcgttattttcttgaccaacagaaaccgaatccatcccactagattggaattttgcaagagaactatctagttgctctacgcacgccattaacacatttttgttttcagcatttttgcgttgttcttgttctaattcatagttgagatttaaggcaacgatcgacaacactttttcaagctgaataataccagattgctcttttagcactgcaactcgatcttctaaccgcttggctgaagccaataacgcctcttgttgttctggtgggcaatatagacgtagcacttgtccaaagagcgataattcaatgttatttttcgacattgttgagaaatccttacgaacacaaaaatttttgctattatgccaccctttgaacaaatcacaaataatctaatatggcaatttcacaatcaagcgactttaaacaactcatttctgagttacatatcgactatacccctgctgaatttcacggttttttaagcggattaatcgctggcggtattcaagatgagtcttggaaaacattaacctatcaatttaccaatgatggacacgcattttctcaagctccacttgcaaaattaaccgaattttatcaacaacttagcgatagttttgatgaagctaacacactcttttcattatggttaaatgaagaagatggttttgcaatggcagatggtattgcagaatggactgggcattttttacttgggttaggtttagcacagcccactttgcagcaagaaactgacgaagttggtgaagccattgatgatttagatgaaatcgccaaattaggttatagtgaagaagataaaaatgatgaattgcttgactcaggcgaagaaattattgagtatctgcgagtcgtcacactctttttacatagccatttcgccaaacctaaaatggcggaaaaaccaaaggttcattaatatcaggggcatacgccccttttattatgccgcttggcgatgataatgccttaacgcctgctctttttgacgggctgagctaaaagatgaaatcctttttaaataaccgataactctagtggcgtgatcgatgtctttagaaccgcaacagctacattgtgaaagggtgcgtttatcaatatggtcacaggtgttacataaggtgattttcacattgatacaaaaatagttacagcccgtttttgccgcaatgtccaatagtgagcggtagctttgctggctcagggcttcttctaaattcagatgtaatgctgaaccgccatcaaggtattcaaccaacgcttttccgtgtaatagaaatttatctaacgcattgatttgttcatcttctaccacatagaaataagagttatagcactctctcggtacaacatagcccgcttctttatcccacttcgcatttttcacccctaaattttccgcagggacaaattcggtattaaatttcacgccgtaggttttataagcggtctgattggcttgataaattgcaaatagtcgctcacgcacaaaatcaatatacgctgaattgtaacctaccttaattccccgaaactcagccgcttcgaccattccgttaatgccaatagtcaggaactgcttatctaatgaaataaaccctgcgtcataaacgggcaacattcctgctttaagataatcttccattagctttcgataagcatattgatattgatggatcttgctgacttctgtcgccaaatctcgtccatcttgctccaaacggttcatattgagtgtaattacattaattgagccagttgcaacaccaccagcccctaaggagtaagaaaaagagtgatcggcaatttcattgcgtaaacggcaacaagatgcaagcgaatcaggattatccgattgataaataaagaaggaatttccttcggctaaggcttttgccattttatcggcaaactcactgtctttgcatttgccattttcagtcagcattgccgctgtcacgactggaaaggttaaaatcgcttttgtccgctcttgattaaaccactgcataaagaaatcttgcaacgctgatgtggtttgccaattcggtgcggtgagatcagaaaagacaaaattgccgaacatcgcattaaaatagtaatggtcgtaaatggaaatattccaaaagacactttgataaccacgagcggcagcaggttgattaatgctatacaccacttgctgtaaatggttggcaatttcgtgttgatgtgtttgaagataattatcgccataatccttacgagcaaaatagtcaaaataggtcaaaaactcgacggttgccactgcccctgcaaattgagagctaatcgcaaagacaaggttaataaaagatccacaaaaagaggcaaggtgttgtggtgcttgagattccccacccagtttggttaaaccgtctcttaaaaaaggataaagtgttaccgatacacaataaggcttcagactggtttcatcgtgaacatagatttcgtgtgcttcaatttgacgcagatattcgtccgcaagggattgaccaaaaatctctgcaattttaccgcttactttggctcgattgatttgtacaaagaaatccttcatcaattcctgttccattgttgctaaattcttttgggtaacattagcgttagcgtccatttttgaaccgtccgccgcatttttagcgtgaatgtattggtcgataaaatttaatttgccgagtagttgcgagtgttcaagtctaatcattgtttatcctgtctaaaatgtgcatttagcacttcacctgtttgaagattaataaatcgttggtttgtggtaatacaatttaacccgccaagttcagcaatccagcgacctgttttgacatagtccaacactgctaaaatctctggtggcagttgctcaagctctaatcctgtataaagacaagtttttaaaccagactgacgaacaagctgtaaccgttgcaataacaattcaggcaaccattctccccccataaacaacacacaactaatcagcccttgatattgcgctaatcgctgttgtaagtaaatttctgagagaaactgaccgcttccaagtttccaactttctatgctgtggcaacctttacaacctaaaggacaacctgaaattagaaaagctaaagaggtttcattggggacttcttgccacacaatctgttctgaaataaaacggatctgtttcattatataaccactatatcttgtggctttaaaccattaaaaacacaatatgtagtagtttatgcattttaatgtaaagggaattgataaaaatcaaagtgagtgaaatcactttgataagctcaaaagaaaaggaagaaaatcaaaaggatagaaaatgtaaattttttcgtatgattaatgccccagccaatttctcaacatctgttccccgtattccgtaataaaagactcagggtgaaattgcacgccatagatcgcaagagagcgatgtttaactgccattaatacgccttgatcgcaagttgcagtagcaacaagcggtgtgttttctaatgatttttgcgaaattgcccaagaatggtataagccgatattgaattgcttcggtaaatttttaaacaatgggttggcttgttgctgaattaatgggcgttgctgtccgtggcgaacttgattaagattgtaaagttcaccgccaaaaaattcgcacaaagtttggtgtccaagacaaacccctaaaattgacttatgttggtgataacgttctagcattgcaaatagttgtggatatgctcttggtacatcaggacctggtgaaatcataatatgactaaaacgttccacatcgtctaaatctaactcttccaccgacaccacctgcatttcaaccccgattttgcgtaataaatcaacaaggttaaaagtaaaagagtcgtgattatcaataataagcaacattaaacattatcctgtgttatcggtttttcaaccagtaaatgtaaacgagtcgtatcccaatcagtttcaagcaattcaacttgtggggtagtttgctgtgcttttgcagaaagctgttggaaacgctcgactttgcctagcaatccctgtttaccgaccagtgctgttacactttggttatattgattgcttgcagtattcaaggtattacccaatttagcaagacgctctgcaatgacgcaaacctggttataaatatcccctgctttttcactgatctctcgtgcctctgcattacctcgctcaattcgccataaatttgcgactgtgcgtaaaatcggcattaatgttgtgtgagaaaccaaaatgacatcacgttcatagccataattaaagagctgtggatcgtgcttcattgcttcaatataagcaggttcaatcggtacaaacatcaacacgaaatcaggactttttatcccaatcaactggctataatttttcttagacaatccatcaatgtgagtacgaagtgaacggcagtgttcatcaagtgcttgttgaattgcaaaattatcttcggatcgtaccgcttgatcgtaggcaatcaaggaaactttactgtctaaaatcaaatgcttatcgtcaggcaacttcaccacaaaatcaggagcaaagcgttttccctcttcatctcggtagctctcttgggcaacataatgttccccagccaaaagccctgctgtttgtaacgcactttctaactgaatttctccccagtttcctgcaattttattattgccttttaatgccgtagtgagattttgtgcttcctgtgacattgacagcccaatctcaagcacgcgtttgatctcagcccctaaatccgcattgccttttattgcttcactatgcacctcattgacacgtttttggaaactttcgatctgctctttaaaaggcttgagcagtaaattgagtgctgactgattactctcagaaaaggatttactcttttcttccagaatttgttgagcaagatgttgaaattcaacatttaactgctggcggacttctaggaaattcttctgttgagcttcaaaatttgcctgtttttccgaaagtgtcgtgcgtaattccgttaattcttgctgtgattgggaaaatttagcctgtaactgaccgctttctgcttgctgatgttgtagctgtaactgagtttgttgtaactgttcttccaaactttccgctttagtctgagccgaaccgatccgctcttttaattcattaatataacgctctagttggtcttcctgtaattctgcctgcttaagctgttgctgaagtttttgaatcgctaaatctcgttcatttaaacgctcaagggttgattctgcttttgtctgttgctgaacggcaaattgttctacttgatttttttcaagggaaatttgctcatatttttgcgagagcgttgaaaactgctgttgcaattgttcaagatcctgttgtcgttcttgactatctcgttgtgaacgggaatagctaaaaaagagccaaagtgagatcaataagagtaatgctatcgttgcataaagccaaattgggtcgagattcataggaatatatactgtaaaaataactagtgttattttaacgagttttgctgttaaaaagcaagggggaaaagtagagtcagaatgggacagatgtgctctatataaaaaattgctacaatagcccactattatagccttgcctatatacaagctatcattttttacaaataggattttatatgacccaatatctttcaacttcatttccagctcaccgccctcgccgtttacgcaaacacgattttagtcgccgtctagttgctgaaaatagcttaactacgagtgatttaatttaccctgtatttatcattgaaggggaaaatcaacgtgtaagagtgccttcaatgccaggtgttgaacgtttaactttagatcaattactgattgaagcggaattattagtcaaatatggtgtgccagctatcgcacttttccctgtagttggcgatgcaaaaaaatcactgatggcagaagaagcttataatcctgacggtttggcacaacgtgcagtaagagcgttaaaacaagcctttggagaaaaattgggcgtgattacagatgtggcgcttgacccatttacgactcacggacaagacggcattattgatgaagatggttatgtggtaaacgacattacgactgaaatcctagtgaagcaagcgctttctcacgcacaagcaggcgcagatgttgtcgcaccaagtgatatgatggacgggcgtattggtgcaatccgccaagtgctagaagctcacggttttatcaatacccaaattatggcatattctgcaaaatatgcgtcaaactattacggacctttccgtgatgctgttggctctgcgggtaacttaaaaggtggtaacaagaaaacctatcagcttgatcctgcaaatggaaatgaaggtctgcacgaagtcgctcttgatattcaagaaggagcagatatggtgatggtcaagccaggtatgccttatttggatttagtttatcgtgtaaaagagacgtttggtgtgccaacttttgcctatcaagtatcgggggaatatgcaatgcatatgtctgcgattcaaaatggttggttaaaagaaaaagagtgcattatggaatcactgctttgttttaaacgtgcaggggcagatgggattttgacctattttgcgaaacaggtagcagagtggttgtatcaagaaaagtataaatgagctgagttacggagaacatggcgctactattccaataccttccatatggaactttaattttgaagtagaattactggacattgcccctatattgcttttaactctatactattatttatgattgatggaatgtaaaatttttccaatctgaatattgggtagaataattaaatgaattaataaaaattctggtatgtcaggaaataaaatgcttatgaatttgctacatccaaccgatttaaaacagtgccaactcgctcatcttcattccttcactaaaggaatgaccgtatataagcaaggcgaaaccgctaaagagttttattacgtcaatagtgggcttatcgggctttatcacaccttagataacggcaaagagagccttgttcgcctataccaaaagggcgactacttcggttatcgaactttgtttggcgataatggctaccattgcaacgccaaagttttggttgaagcagagatcattcggattaagcctaaagacattgatactttcttcgtagaaaatccgcagatgagcaaatttttgttgcaatcccttgcaaatgaactgcgagaagcggaacaacgcttggcaaaaagtgcctatttacgcacccttgatcgtgttatcgacagcatttattttctcacggaaaacttcccttactataactggacgcaccgtgaaatcgcagaatatgccggttgtgaaacggaaacggcgatccgcattactaaagagttgaaacgcagcgggttattgcaagattggcataaacagaagtaggtcgctatgtttgaaaacgcccccaaagcccactttcatttgatggcaaagccgagtagctttcaatgtaacatcaaatgtgaatactgcttttatcttgaaaaagcacataccattgcgcaagatgtacgttttatgaatgaagacaccttgcgaaattatgtgcgtaattacattcaatccagtgcaggacaacgggttgaatttgcgtggcaagggggtgagccaacgttattaggcttggatttttttaaacaagcggtcagatttcagcaagaatttgcaaacggcaaaacgatcaccaatgcttttcaaaccaatggcatcgccctaaatcgccaatgggcagaatttttcaaaacacatcaatttttgattggtatttcgattgatggcttgagcgaagtacataacaaatatcgcatatcagtcaatggtcagccgacttttgaacgggtcaaacgagcggtagatttattgaaagactatggcgttgagtttaatacattgacggtgattaacgatcaaaattggcataaaggcagagaaacctaccttgctttaaaagagctgggttcaacttttatgcagtttattccgattgttgaaacaggctgtggcacaacaccttttgcaaaaaaggacgcaaaaccgaccgctttctctgtgccaccacagggctatgggcattttctgcttgaagtgtttaaagagtgggtgcaacaggatgtcggcaaaatttatgtgctggaatttgataatctgcttgggcaatggcttggctacccgtcaagtagttgtgttcatcaggagagctgtggcacatcactgattgtggaagcaaatggtgatgtttattcctgcgaccattttgtttatccaacctataaagtgggtaatttaaacgaacagccgttgggcgagattgtgcattcccaacctcaataccaatttggacaacaaaaaagaaccgcactcacgcaggcttgcttggcttgtgatgtgcgaacgttttgtcacggcggttgcccgaaacatcgaataattagcttgccaaatgaagcaaacaaacacaactacctgtgccaatcctatcaactctttttccgaaaaaccgccccatttatgcgaaaaatgcgagatattattcgcagtggtggatcggctggggatattgtgaattttattggcgataaagatgctaacaagaatatataacaaacattattcattggataaaaaaagaatacagccatatgacctttatgctaataaaagagttataaaaaaggtagtcctgaggtcagctgaagaaagaaaaatcttatatttatcaatgagtttctaacctttatctaaaaaagaaggtgtaatagacaaaatagttgctgattcgtcaaaaactatgccaagacgacaaaacagttgctaatgtttattttctctaaatgttagcaacacttttgtctactatgccttttaagttaactactcacaatcaccctcaagctatccaatcgccaatttgcttggtctagatgtttcagtgatgcttctcgcaactgctctagggcttgaatttcatcagcacgaatgtttttattcactgcttgtagtgatgtcaagcggtgtaattcagcacctaaagtgtgatccgcattctgttttgcctgttcaattaaggattgtgcctgtggtacaactttttcatcgctgaatgcaatcagcttctcaatatcaccacgagccatcttcgcaattttatttgccatctgtttattgaccggcttgagctgtttttccaaccctgcaaacgacacctgcgatgccatatcgttgcctttgttatccagcaagatacgcataggcgttggcggtaggaaacgggtgagctgtaaatcttttggtgcttgggcttctacgatatagatcgcttcaagcagtaacgtgcctgccagcaagtttttattaacgagtaatgaaacagcactcttaccaatatcggcggacgtaataagatcgataccgttgcggatcatcgggtgatcccacgttaagaacaacacatcttctcgcattaaggcaagttcacggtcaaaagtcacggtgttgccttcttcagacaagcctgggaaatcaggcacaagcatatgtcctgtcgggctaatcacaatgcttttctcgcccaaatcttcctgctctaagccaattacatcaaataaattcaaggcaaaattgaccaactgcggattgtcgtcttgttcagcaatagcttgagctaattgttgagcagtttcaccgccgttcgagttgagttctaacagacgatctcgccctttttctaattccactttaagctgttgttggcgtttatgggtttgttccacaaaggcttcgaaggcttcgctacgttcaggattgagtaggtaagcggtgagttccgcattaaattctctaaataacgttgcccccatcggacaagtttcttcaaaggcatttaagccacgatgataccattccgccaagatcaactgggtggagtgattgaaacaaggcacatagatttcaatatcgtgtttttgcccgatacggtctaaacgcccgatactctgctcgagtaagtctggattatcaggcaaattaaacagcactaaacggcgtgcaaactggaagtttcgaccttctgaaccgatacttgagctaatcagaacctgcgcgccatcttcttgttgagcaaagtatgcagaggctttatctcgctccacaatcgacattttttcgtggaacaccgcagagcgaatagcttctttttcacgcaacacttgttctagctgaatggcggtatccgcttgcttacaaatcaccagaattttttcatcacgatgatttttcaagaatgtaattaaccactcaatgcgtggatcaaactcgtgccacttcgcatttgggttcatacgttggaataggcgttcagggtagagcagatcttccatcttatttccccccatcatacacattactttcaaagcatttgcatattgtgtaggcatttccaacacaatttcattgtaaatacgatgtgggaagccttttacgccttggcgagtattgcggaatagcacacggcttgttccgtgtcggtcaattaacttactaattaactcttggcggacttcccgactctgttcttcgctagcatccgaattaataatacggaacatcggctcaacatcttcttccgccagcaattcgctgatactttcctgctctttggcacttaacggcttatcgttaagcaaggtagcgaccgcatcggcgactggctgatactgtttttgctcttccacaaaggcttgataatcgtagaaacggtcaggatctagcaaggctaaacgagcaaaatggctctcttgtcctaattgctcaggggtcgccgtgagtaacaagactgctgaaatctgcttggagagctgtgcgacaaactgatatgccatacttggattttgctcgtcccattccaaatggtgagcttcatcaacaatcaacatatcccaatcggtatcaagcacttgttttgcacgctgtggatttgccgataaccaatcgatagaggcaatcactaaggcttccgtttcaaacggattttcactgatgtcgttattatcttcatctttcttagtgaaatcggcacaacgttcctcatcaaacagcgaaaaattcaggctaaaacgacgaagcatttcaaccagccattgatgctgtaaactttccggcacaagcaccaatacacgatctactcgtccggagaaaagctgttgttgcaaaatcatacctgcttcaatggttttacccaaccccacttcatctgcaagtaacacacggggagcaagacgttgcccgacttctttggcaatatgtaattgatggggaattaggcttgcacgaataccacgcattccacgcagttcagattgaaactgggcttgttgatgcttcaaagcacgataacgcagggcgaaacgatcactgcgatcaatttgggcagagaatagacgatcctgcggtttactaaaactcactttatgatcgagttgcatttcaggcagaacgctctctacttgagtatcgacacgtttacctaaatagagtgcaaccccttgattttcaacgacatcttcaatatctaactgccagccatcaatactggtaacacgatcgcctttttggaattgcacacgggttaaaggggcaacggcaacagcgtacacacgttgttcgtccgatgcaggaaatgaaagggtcacagtgcggttatccactgcagtgacaatgcctaatcctaagttattttccgactcactaatccaacgttgtccgactacaaagctcaaacttacctctctgcggttctactaaaattttcggagactatctgatcttggtggagtaagcggtcagattttgccattattgtttccataatttgaactgattaatcaaaccattcgttgaactgtcgtggctagtaatggtttcgttattttctagctctggcaagatacggttagcaagttgtttacctaactcaacaccccattgatcaaagctataaatattgaaaattacgccttgaacgaagattttatgttcatacattgcaatcaacgctcctaaggtgaatggggtgattttttggactagaattgagttcgttggtttgttgcccgtaaatactttaaatggcacaatttctacaacttcttctaaagatgtacccgcttgtaagaactcttgttccactacttcttttgacttaccaaaagcaagtgcttcagtttgtgcgaagaagtttgaaagcaatttagggtgatgatcgccaatcggattatgggtttgtgcaggtgcaataaaatcacaagggatcaattttgtaccttggtgaattaattgatagaaggcgtgctgtccatttgtacctggttcaccccaaatgataggccctgtttggtaattgacaaattttccatctcgcccaacatatttaccgttagattccatattgccttgttggaagtaagccgcaaaacggtgcagatattgatcataaggtaaaattgcttctgattctgcacctaagaagttattgttccaaataccgataagggcgagtgtcaatgggatattttgctctgctggggcattaaggaaatgtttatccattgcgtgtgcaccatcaagtagttgctcaaagtgttcaaaaccgatagaaagagcaatagataacccaatcgcagaccagagtgagtagcgtccaccaacccaatcccaaaattcaaacatattttctgtatcaataccaaatttagcgacctctttggcattcgttgaaagagctacgaaatgtttcgccacagcagattcgtcttttgcagtatctaataaccattgacgtgctgaaagagcattcgtcattgtttcttgagtagtaaaggtttttgatgccacaaggaaaagggttgtttctggattgattttcgctaaggtctcagcaatatgcgtgccatcgacattagaaacaaagtgcattgttaagtgatttttgtatggacgtaatgcttcagtgaccatatatgggcctaagtctgaaccgccaatcccaatgtttaccacatcagtaatcgccttgcctgtgtagcctttcgacacccctgaaataacacgctcacagaagcctttcatcttcgctaaaactgcattcacttctagcatcacatttttgccatctacttcaacaggggtatttgagcggttgcgtaaggcggtatgaagcacggcacgattttccgtacggttaattttttcgccattaaacattgcgtaagtggctgatttaacttggcattcatcggctaattgacgcaatagtgcaagggtgtgctggttgatcgcatttttagaaaaatcaacgagaatttgatcttcaaaacgtaaggaatatttatcaaaacgttttggatcttcattaaatagttgtggaatcgtcaaattctcagctttgtgctgttcaagggcattccaagcgaaagtttgggttggattgatgttttgcattgaattatcctctaaaatttaattttgtgattcagttgatgatgttgagcttagttcatctaagcgtttttctaattcattcaatttttcacgggtacgaagtaaaacttgagattgaacttcaaactcttcacgagtgaccacatcaagtttagcaagctgggcttgtaagatttgtttaaatttttcttctaaatcattgcctacattttttaaaccttgtggtaatgcgttgtgaagttgctgtgcgatagactctaaattttttggattaagcataatgttccccttgtaaattagggcattaattctaaagaatttcagtaaagataaaaagcaaagaatagagagaatttgaaaaatcagagaattattttatctagagaaataagaagatggctggggtactaggattcgaacctaggaatgctgggatcaaaacccagtgccttaccgcttggcgataccccaaaagaaaaaaactaacttgcgttagttcattcgatttgaaataagatggctggagtactaggattcgaacctaggaatgctgggatcaaaacccagtgccttaccgcttggcgatactccagtcgttttatttgcaagcttaaaatggtgcgggacgagggacttgaacccacacacctctcggcgccagaacctaaatctggtgcgtctaccaatttcgccagtcccgcaaatggtggctacaacgagattcgaacttgtgaccccaacattatgagtgttgtgctctaaccagctgagctatgtagccatttgcgtcaccatatcggctttgcggggcgtattatgctgatttcactctacctcgtcaaatacttttttgaaaaaagtaaatttttctgcttgtttgactagagattcggcaaattgtcagaaaaaacaacaataatctctataaaagactgattttataataagttaacgattgccgttttaaaattccatttcttgttttatctgttttaatataggttcaacatctggtaatacatcttcccacaactgaaacgtataagctgcttgtccaactaacattcctaaaccatcttggtattgtgttgccccttgtgaacgggcgtattcaagaaatggggtctgcatatttggagcatattgcatatcataaatgttggcttgtgtaagtaatcgtgctggcaattcgacgcacttgccttgcaatccaagcgatgtcgcattgataattaaatcgaacgactgttcgggaagttcatcgaaacaagcggattgaatttgcccaaactttgcaaactttttagctaaactggccgctttatctgccgttcgattgtaaatggtgatctgctgttgagcttgtaataagggataaagcacacctttggttgctcccccagcccctaaaatcagtatccgttgatgtggtttaagccaacctaaacgggcaagatcggacactaatccaacaccatcagtattatccgcatataaacgcccatcatctaaccgcttgagcgtattacaggcttcggcttgtaagcaactttcgctataaagatccgcaagggcaaaggctctctctttaaaaggggctgtgatatttgcacctttcgcaccttctgcaaaaaattgtttgagttgctgttcaaactgttgttcatcgcctaatttcgctacataagagatcgctttgcccgtttgttgcccgaaaagtgtatgtattcttggggatttgctttgtgcaatcggatttccccacactgcgtactggttcattgtctatccttgtcgaaaaatatgttggctaaaaatgtcacggatttcagacggatttgattttccgcctgtggcttgatctaatactgggaacgagttgccaaattgctgtcgcacttcgtcggcagttcggcaaggtgggagcgtcgttaaatttgcactggtagaagtgagtgcaaaacctgtcgctgtacaaagttcaacaaccgctggcacttggcataatcgcacggcaatggtttcaaactgccctttcaaataacgtggaaccgttgctttggctggcattatccaagtaatcgcctgctcgccaagcgtttcaaaacgttgccattccacctctgtcaaatgtgtatcatcaatgtagggcagaagcagttctttatggtgagcaattaaaatcaaccccttgtcttctggacgattttttaattgaagcagggatctcaccgcttgttcactttgcggattgcaacctaatccaaaaacggcttcagtaggataggcaatcacttgattttgtttaagtttttcaataagttgattaaaagaatacattattcgctttcactaaatagatgctgacattttctgtttgcacagagaaaataggttttcccacgcactttttttatggtggcgagttcacccaaacattgtgggcattgttgttttacaggcttggtaggtaaggtaaatttacactcaggaaaacctgaacagccataaaatgttttacctgaacgccctgtgcgtgccactaatttatgtttttgacattctgggcagtcaaattcttcttcgatttcagtttcttcgtgtaccgtaaaatggcagtcaggatactggctacaaccgataaacataccaaaatgcccttgttttaattgcaatggcgattgacattcagggcattgttcatcaagggttttgatgatatgacttgcttggtggataggtttgagataatcgcattgcggatagctactacaccctaaaaaaagcccctgctttccccgttttagttgtaatggggaatggcattgcggacataattctgtctgtttcgtggacttaaaaaggctcatttttaaactatattaactcaaattcaatcacaaaaaagtcgttatcgttcgggtaaatctctttgatcacttgttttagttcggcaagtgtcatattttcctgtttagcatgtgtttcattaagccgttcaaactgaataggggtaacagacagcacacgaatacgggcaaacaagcagtctgtttcatttgtaaaaacactcaactcttgacccgcttgaaaatagctttctgacttatctcgaatggtaatggtctttttaccactgacaatatctgcttcaaaacggctaaaaaaagtaattttattcatcatagtccccataatccagatccaataaatgcctaaaatgatcgttataaaaaccgtggctaaccatatatcgccacattttttgcttcgcttttatatcccaatgtgatggtctttttttctcaaaaagacgttcggcaagttcaaaaaaatcaacttccgcttcatcaatggcttggctaatcacccactcttttacccctttgagctgtaactcttgttttagacggcgtggtccatagccttgttgtgaacgatagcggacgtaacttatcgcaaagcgttcatcactttgccatttattcgcttttgcttgttcaatggcttgctcaatttcttgtgcattatattctttaagttgtaatttgtggcgaatttcagcttcgctatattctcgtttagaaagtagataaagcaaatagctattcgcagaatatttatgtgtcatttatttaccgcagtaaaataaaaatgcggttttcacaaaccgcatttcgctattatagttcttcttcgttaaactcttcgacatcgctctcgtcgatactgtcgcttgccgttacttttaataggctatttgggtttgaagccagtgtatttcggatttcttgttcgagtttatctgcaatttcagggttctcttttaaccatttcactgcattatttttaccttgtccaattttcgttccatcataagagaaccaagcacctgatttcttaataaagccgtttgcttcagctaaaatcagtagttcgttcatacgagaaattccttcgccgtacataatatcaaattgtacttcacggaatggcggtgcaactttgtttttcaccacttttactttggtttcactaccaataatttcatcgccatctttgactacaccgcaacgacgaatatctaaacgaacagaggcatagaatttcaatgcattaccgcctgttgtcgtttctggattaccaaacattacgccaattttcatacggatttggttaataaagaccactaaacagttggtatttttgatatttgcagtgagtttacgcaacgcttgtgacattaaacgtgcttgtaagcccatatgcgagtcgcccatatccccttcaatttcagcttttggcgtaagtgcagcgacagagtccacaataataacatcaactgcccctgaacgaactaacgcatcacagatttcaagagcttgttcaccattatctggttgagaaatcaataaatcatctgtatttacccctaaattgcgagcatagacaggatctaaagcgtgttcagcgtcaataaaagcacaggttttattgcctttttgagcttgagcaattaaagaaagtgttaatgttgtcttacctgacgattctggcccatagatttcaacaatacgccccattggcaagccaccaatacctaaagcaaggtctagccctagtgagcctgttgaaacagactcaatatctaattgctcagtctgccctaatttcataatagagcctttaccaaattgtttttcaatttgagctagtgccgcatctaaggcttgttgtttctgttctggtggaacttgtttaatgacggtattgttttttgaagattttttattctcagccataatgctttcctttgttcattgtttggatagggcaaatgcattgccataaaactgtaaattattatactgtttaaccatacagttgcaactatttttttcagtttttcgatctatatcacaaaatttacaactttatcgaaaaatcctatcgcttgtaatcggcactgccctttgaagatcaaaaggatttaaggcattaatcaccattatttgttcataatcaaaaagtgcttctacaggtatatcaattaagctaattttttgttcgtctaataaataacttagttgtgtaccttttaataaataatgatttgggctataccattttccttgttttaaaaaaagtaaattaccaatagagcaatcactaataaagccattattaacaagaataatttcatcaccagcggtttgttttaatttatctaattcaactcggtcagtatatttgaattgataatcaaaattttctacataaacgcattgaaagttttttattgctttaggtatataatggaaaaactgaacttgatattcttttgtgttataatcaatacgacaacgtactaatcctttttgatatgcttcaggcactttaataatatctaacagttcaaaactattttcgtgcttaaaataatatataaatgcattattcattcgttgttgatgataaaaaatattttgtatcttaccatcaataattgctaccgtttcaaagagtggatattggcacataaactttctctaaaatttcattatattctccatctagctgacttaatgcagtaattccgccaccgctacgaaaataatatgtatccccttgtttttcaatatagcgaatagccaccgcactctctacattttcaccatcaaaataaccgaaaatccccgtataataaccacgttcttgttgttctgcttgttgaataatttcaacggttttcactttaggcgcaccgctaattgagcctgctggcaagagtttatccaacattgtgccaatattttcttgccaattttcatcaagttccccacaaatttcagaactcgtctgataaatcgccccacgatgtgtttccactttttcaacatagcgatatttcgtgacctgaatatattttgatactaaagctaaatcattccgaattaaatcaacaatggtattatgttcggtaaactctttttctgaatttaataatttgtttaccgcatcttcttcatttgcatttattgttcctttcataggataagaatagattttattcgctttaatacgaatgaaacactcaggggaaaaacagacaaatctttcatctaataacaatttgtatttagctttactttgctgaaaaatttgtgctaaatgataatttgttttaatttcagtttgctgagttaagtttaaaagataactattcccaatttggatctgttgttgaacaaaatcaaaggcttttttatattgtggataatcaggtggaataatctctaactcaaaatttccatttatttttaatggttgaatgaacttttgttgtccattaaaatcaaaataaagccctttatcttcaatttcagataaaggataaattaatggtttctgtttttcaaaatcaattaaaaagaaaaaaggcaaacgcatttttccatactgattggctagttgaataaattgttgcattttaatatttctattattcggagttaaaacctatgtcccattcacattcttatatggagacgcacgcccaacaaaataagactatcctattgattagtttagctattataacgacttttatggttgttgaagcaatctctggctatttctttaatagccttgccttacttgctgatgccgggcatatggcaagcgatagtttatcgctcttattgtcactttttgcataaccttgcaaaacgttttcacgaaatggatattcacgctacattgcaaaatgatttagccgtttattttgaacagcacggaaaaacagagagcacccaccatcattaactatttgatattaatcaaatagttaataaagaccgactaaaatagtcggttttttgttgcctttagttaaaaaaagcataacattttcaacatagtgcaactttggagaaaaatatggacaacttaatttgctataaacagatgccagtttgggataaggaaagcctaccacagatgtttcaagagaaacataatactaaagtaggaacttgggcgaaattaacaatcttaaagggatcattgaaatactatgaattaactgaggaaggtgaaatcgtcagagaaatgattttcgacgaacaaaaccagccaccttttgtggagccacaaatttggcataaagttgagccattaagtgaagatctggcgtgtcagctcgctttttattgctcgccggaagattatttcgctaaaaaatataatctcactgcaacacattctgaagtattaaatgcgataaattatctttcgacaggcaaagtgttagaccttggctgtggaagagggcgaaatgcactttatcttaacttaaaagggtttgatgtaaccgcagttgatcagaatgaagaaagtatccatttcctcaattcaatcatcgaaaaagaagatgcacaacatatccaaacgggtatttacgacatcaaccaagctaatatacaaggtgaatttgactttattgtttccactgtcgtaatgatgttcctaaatcgtcattgtatccctgcaattatcgaaaatatgcaaaaaaataccaaagtcggtggatataatcttattgtctgtgcaatgaacactcaggatttcccttgtccaatgcctttttcatttacattccaagaagatgaactgaagcagtattatcaaggctgggaacttgttaaatacaatgaagatttggggcatttacataaaaccgatgaacacggcaattgtattcagctacgttttgtgacaatgttggcgaagaagttggggtagatcgcgtagttctaatcttcaactcaattttatggcataatggaaactttataagaatctattgttatcaatgacaatagatttagaccattgacaaactatatattagatggattgaatattgtagggtgggttttaacccaccaataaaatcaatatgttacggctatatggtgggtcaagacccaccctacaagctactttgtaaataatctgaatctattgttatcaataacaatagattcttcgttttatacattatttggattttatcaatgcaagaaccttactatcgcgggcgtttttccgttgcaccaatgctcgattggacaactcgccactgtcgctattttcaccgtcaatttactcaacatagcctactttatagtgagatgattaccgcacccgcaattttgcacgcgaaatatgatctgcttgcttacgatcccacagaaaaccctgtggcgttgcaattagggggaagtgatcctgaacagttagcgaaatgtgcaaaattagtggaagaacggggctatgcggaaatcaatctgaatgtcggttgcccatcagatcgtgttcaaaatggtatgtttggtgcctgtttaatgggaaaagcggatttagtcgctcgctgtgtagaagcaatgaaaaaagaagtgagtattcctgttaccgttaaacatcgtattggcattgacgatctagatagctatgaatttttatgcgattttattgagaaaattcagctttactgtaacgattttattgttcacgcgcgtaaagcgtggctgtcaggtttaagcccgaaagaaaatcgtgaaaccccaccgcttgactatgaacgagtttatcaactcaagcgggattttccacatcttaaaattagcattaacggcgggattaaaacgattgaagagatcaaacatcacttgcaatttgttgatggcgtgatggttgggcgtgaagcctatcaaaatccgtctttgcttggttatattgatcaagaactgtttgacccaaacgccgatattgttacaccaaaacaagccgttgaaaaaatgctaccttacattgaacagcaactttcacaaggcgtttatctcaatcatattgtccgccatattcttggagcattccaaaactgtaaaggggcaagacagtggcgtaggcatttaagtgaaaatgcgtgcaaacaaggggcgggtgtagaagtggttgaacaagcattatcttttttgccttactagttgcaaaatctattaaatacttaacgactcaggtgcttatggtttattgcaggtgtaatagacaaatttgttgataaaaagtggcttaacgccttatagtacaaggccttaagccctctttttgaaacatgaacaaaaaactgcccattttgccaaagtctgaaaataaagaaacatggtacatcaaataatattcaacgatattttgtcataagggtcataaaacattttcccttaagaataaattagatccaataaaaatttggactgattacacatccagaaaacaaacctatcaacaacttgccgttaaatatcattgttcagtcagaactattcaaagatatattgataaagcccctacaacagctttaaaactacctttaaatcgatacttgaacatcattatggatacgacattcttcggtcgttattttggtgtattggtgttaatggattcaaattcaaacaacgtcatttcccattattttgtgcgaaccgaaaaagatatttactacaaacttgccctgaatgggttaagagaaaaagactatataattcaatcaattgtctgtgatggtagacgtggtttgatgaaagatttatttaatacgccagtacagatgtgtcagtttcatatggtggcaattgtgatgaggaaattaagaaaaaaacatcaatcacaagcgggtaaagaattaaaaataattgcaaaaacactcacaagaagctcaaaaaatgaattttatcggcgattacactcttggttcataaaacaccaagcattttttaaaagaaaggggttataaagcgaatgaaaaaggctattttccttataaacatcgcaatgtaagaagtgcttatgccagtttaaaacattatatggattttatttttatctatgaaaaacattctgaattaaatatagaaaagacgacaaatcgcttagagggattatttagtgaacttaaacgaaaattaaataatcataatggattaacgaaaaagcgtaagattatgtttatacaggatttttaaataaaaagagttgctaacatttaaagaaaataaacattagcaaccattttgtctactatgcccctttatctactatactggattaaccattaatcatctaagaaactgcgtagagtttcggaacggctagggtggcggagcttgcgtaacgcttttgcttcaatttgacgaatacgctcacgagttacatcaaattgtttacccacttcttcaagggtgtgatcggtattcatatcaataccaaaacgcatacgcaatacttttgcttcacgaggtgttaatccctcctctaatacagcattcgttgcaattcgcaaactttctgctgttgcagaatcaagaggcaactcaagagagctatcttcgatgaaatcccctaaatgtgaatcatcgtcatcccccactggtgtttccattgagattggctctttagcaattttgaggactttacgaattttatcctctggcattcccattttttctgctaactcttcaggtgttgcttcacgtcccatctcttgtaagcattggcgagaaatacgatttaatttgttgatcgtttcaatcatatgcacaggaatacgaatagtacgagcctgatctgcaattgagcgagtaatcgcttggcgaatccaccaagtcgcataagttgagaatttataaccacggcgatattcaaatttatctactgctttcattaagccgatgttaccttcctgaattaaatcaaggaattgtaaaccacggttggtatattttttagcaatagagataacaagacgtaagttggcttctaccatctctttcttcgctttgcgtgcttttaattcgccatctgcaatgcgtccgccaatttcacggatttgcgtaatggttaaacctgttgtttcctcaagtttctgcaagtttgcgatatttacacgaatattatctacatagttggctaattttggcacaccaccctttttagcattgatcgctttatcaatccacgcctcagataattcattaccttggaatactttgatgaaatccgtctttttcatgcctgcatattctacagcatagcgttgaatttgacgttcttctgctcgcacttgcttcatcattttttgcatcgtttccactaacaaatcaaattgttttggcactaagcgaaattcacggaaaatatcggaaagtgcttgaatttgatctcttgaacgcttgctagtacgtccatgtttttggattgcttgtaaggctttttgatgttgctcttttaatagcgtaaatttctcacgagcaagttctggatcaatgctattatcatcaccaccatcgcctgatgattcaccatcttcactttcatcatcaatatctgcaacggtatcactttcgctttcttcatctagatcggcatcgaggtcatctacaggggtactttctaccgcattcggatcaacgaaagcggttacaagatcggataaacgtacagtgccttcttcaacttgatcataacgagcaattaattcacttaaggcctcagggtattctgcaatgacacactgaacttcgttaattccttcttcaatgcgttttgcaatatcaatttcaccttcacgtgtaagcaactcaaccgttcccatttcacgcatatacatacgaacaggatcggtagttcgaccaatttcagattctaccgtagaaagtactttagtcgcctcttccactacgtcttcatcggcaatattgcctgcaagcatcaaatcatcggcatcaggggcagtttccagcaccttaatccccatatcgttaatcatttgaataatgtcttcaatctgatctgcatcgacaagttcttcaggcaaatggtcgtgaacttctgaaatcgttaagtatccttgctcacgcccttgagcgataagaagttctaactgagattgttgttcttctaattgagagtattgttccatagctttatccgttcttaagagcaaaaataagtagtggattataccactgcttgaggtgcgataaatagttttgcaaaaaattataagtatttgaccgcttaccgcccagtcaataacatcattaattcctgtttttcctgctgatttaaacctgttgtacgatcttttgccattaaaatttcaatttgtcgatcaagcagtttcttatagaaaaaatcaagcgtatcaataaaagtgttttcgacattttcaggggataccaagtgatcccaatttgccagcagttccaagtggcgatagtttggactctctcgcaaatgttccaataaaccgcccatcgaaatacccagattagcgtgacaaatattgactaattccagaaaaagatcgaaacctttttcctgcaaactctgtaaaaatgtcacatcttcaggcacattttgaaccaaatgaggattttgaagtagtaacgcaatcagtaaccgcatcggtgtcctttcaatatgtggcatattgtggcgtttaggtgcagtttcaacacttttctgaggcaacatcacctctaattgtgttggatcaagaatacctagtttttgccccaatatatttcgtaaatacaaacgtagcatttcacctgggatacgcttgatcaaaggcaatgctaatgaagcgagcttagattttccctctttagtagaaagatcgacctgcgtaagcaaagaatcaaataaaaattcactcaatgtcaatgcttgttccaaatagcgttcaaaaccctctttaccctgagagcgaataaaggtatcaggatcttccccatcgggtaagaaaataaatttcagttgtctgccatcgtgtaaataagacaacgcattttctaatgctcgccacgcagcatctcgccctgcacggtcgccgtcgtagcaacagatcacttgctctgttgatctgaacattaactgaatttgttcacctgttgtcgccgttcccaaagaggcaacagcattattcaccccaaattgagctaaagccactacgtccatatagccctcaactacaaataaaaactcagggttttcattatgttgtaaggcttgatacaaaccataaagctcattgcctttatgataagtggcagattcaggggaattaaggtatttcggcttttcatcgcctaatactcgcccaccaaaagcaattactcgcccacgcttatctcgaattggaaacatcacacgattacggaaacgatcatacacattgccacgatcatttttagagagcatacccgtatcaagcaacttttgaacttcttcaggattatttccaaagcgacgaagcactgcgtccatcgcattcggagaaaaaccgatttcaaagcgatcaataatctcttgagataaacctcgttgctgcaaataggcttgactagcactatcttgcgttaattgctgttgatagaacttagcgaccaaatctaacaattcataaagattacgccgagttttataactggcttgtggtttgccatctctattgatcacattttcacgaggcacttctaacccgtgcaatgcagcaagttcctcaattgcttcaggaaactctaacttgtcatattccattaaaaagctaatgacattaccgtgtacgccacaaccaaaacagtgataaaactgtttagattggctcactgtaaaagagggacttttttcgtgatgaaaaggacaacaggcttggtaatctcgccctgcttttttgagtttaacacgactattgatcagctcgacaatatcggttcgagcaacaagatcatcaataaatgaacgaggaatagagcctttcattgattatctccttgctagcaagcggatagttttgcaaatttttttacaattcagaccgcttataatggacggtataaacattgaaaccgtgattccttaaaggtttcacggttccaatttaacttctgctacctaatttaaaattagtataaacgagtgttacgcgcgttctcacggaagttacgtttagcatgacgttttgctaaagacgctttttcacgtttacgaattgtagttggtttttcatagaactcacgagcacgaacttcagctaaaagacctgctttttcgcaagagcgtttaaaacgacgtaatgctacgtcaaatgattcattttcacgaactttaattactggcataagccatcacctcaggaaatatatgtttaaatgaagccgcacaaattggtggcggcatagaactaaaaaaggtgaggcattttagcttagactgactaataagtaaagagcaccttatcaaaataatctacaaacatacagcttttccaaaataactttactttggtattcactgaacaataatcttggaaccattagaaaatacgatgcctcttgcctcataaattgcatttaatgcaatattatttctaaaactatcctgcatattctgaggcaaagtatccaatgaaatagaaaaccattttcctatatatttacaatcttactccatcaccaactggtaacttggttttagaaaacatgtataaaaacgaagtatctataaattcttaaaaatacttcaatacttttattcttgtaaagaaaaaataccgattttctaataacctcaaaaaccggtatttacataaattactcctcaatatctaaatatcaatcttattgaattttgtttatagagaagtatatttcatttcaattatacgaaatggacaaatattatttagtatctatgactggtgttgcttcttcagtctgagaagacactgcgtcctttatcccatccactttagtttcaactaattgtttagtttcttctactttagtttctgttgtttgttttacctcagcaactttctcttttgcttgatcacaagcggttaaagaaagtgttgctgcacctaaaactaaagcggccaataaagattttttcataaaaataattcctataaattaaggtttaaattgccacatttagagtaaatacttaggaattagttccctaagcatttacaagtgattaaagatcaaccttttatttttgcacccctaggtgcagaataaacgtggctcactgcactactatgtccgccaaagccttttccgtagaaatagtattttgagttctgccactcttttgcttgaattaaggcaatttcttccgctggtgctgctgcaaccgtcatttctacttgcgtatgtgcaacacgagagaatgtgcctagtttcccttcaaactgatattgactttgataaaccttaatcggttttggaatcggagctgcaactttctgctcagattcgaccgcttgagtccctagctcttccaatttaatatggcgacgttcgtgattttctttaactaaatctcggttagtcggttgagaaaccacaagtccgaatggtttagccgataaagccactgctttcggatcaacttctgcggattctgcttcaactttcgtacgacgtttgtggttgtctttgactaaatcacgatctgaactttgagttacgaaataaccaaatggcaccgctgaatcttgatgagcctgagtgttagcttcctcttttacgggttcagctacttctcttgctacagattgaactggctgttcttgctgttgtaacatctcatcaacagataagaaacgaggtttctcttccgcaacagcttttggcatttcgctaaatttaatccaaaccttaccgcttgcaagttcaggcgaagcgacagccgaagttaatggcattactgcttttacttcctcacgacgctcacgacgacgctgattgcctacgcgtaaatggcgaggtaaacggcgttggcgaggctcacgttgctctgtacgctcttctactacaggctctgaagtttccaaaggcatctctgcatttactgtagtcaccacaggctctgccacaaatgaatcagccgcattctcttctgctggtggtaaagaagcggtaatttccgctgaatgttctgcagtttcaattcgcactttcttacgtaagtcacgacgttggcgacgctcagccactttcgcttcacgctgttgcggaactgaaacacctgccacttcttctacaatttcacgacgtttcttaggctctactggaacgacttcagcttctttcgttgcttcaacgaccgtgtttttacgctcttggcgttcgttgcggtttggtttttcacggcgttgctgacggcgttcacgctggttacgagccttacctttaccttgcttcttctcaggttctttctcttcgcttgcaaacattgctttgattttcgcaataattcgactgattaacgaaggttttgctggctcaactggtgttggtgcaggctgtaaatttaactctgaactttgtaatactgattcaacggtaatcactggcttattacggctaaccaacgcttcttccgaatggtgatgatgaatgtgattttcttcatcttgttcttggtagcgtttcgctaaatcgtaacttaaggttggaacgatctcattctcacgcaggcgatatacgctaaagtgtggggtttccatactttcggttggtacaacaatcacttggacatcgtggcgtttttcaatgtcgctaatcgccttacgtttttcatttaataagtacgaagcaatttccacaggcacaatagcgtgaacctgtactgagttttctttaatcgcttcttcttctaataaacgtaaaatggagagtgcaatcgactcgttatcacgaatttttcctgtaccttgacagcgagggcaaacgtgtgatgacgcttcacttaatgatggacttaaacgctgacggctcatttcaagtaatccgaaacgagaaatgcgtccaaactggattcttgcacgatcttggcgtgtcgcttcacggatacgattttccacttcacgttgatgacgaactggggtcatatcaataaagtcgatcacgattaaaccgcccaagtcacgcaaacgtaactgacgagcaatttcgtctgccgcttctaagttggtatttaatgctgtttcttcaatgtctccaccacgggtcgcacgagatgagttgatgtcgatagctgtcaatgcttcggttacatcaatcacaatagaaccgcctgacggcaaacgcacttcacgttggaatgctgattcgatttgggattcgatttgatagtgactgaacaacggtacttcaccttcatacaggcgaacacggttgataaaatcaggacgcacaaggcggatatgattttttgctttctcaaataccttacgattatcgatcaaaatctcaccaatatcacgacgaagataatcacggattgcacgcacaatcacatcactttcttgatgaattaagaacggtgcagggcgagattctgccgcttttttgattgcctcccagtgatgtaataaaacttttaagtcccattgtagctcttcaggggatttacccaccccagcagtacgcacaattaaacccacatcttcaggtacatctaagcaatctaacgcttctttcagctctaaacgctcgtccccttcaatacgacgagaaataccgccagcacgagggttatttggcattaaaacaagatagctaccagccaaagagataaaggtcgttaaagccgcccctttattaccacgctcttccttgctgacttgaacaataacttccgccccttcttgaataatatcttttatgtttgggcgaccttggaatacataaccttgagggaagtattcacgagaaatctcttttaacggaaggaaaccgtgacgctctgcaccgtaatcaacgaatgctgcttcaagactgggttcaacacgggtaattttacctttgtagatattcgctttcttttgttcgtgtcctgggctttcaatatccaagtcgaacagtcgttgcccatcaacaagggcaacacgcaactcttctttttgagttgcattgattaacattcttttcattgtgttttctcattttatttttgttagtgctattcatagggttcgggtttgtatttttgctaatctgtcaatctcccgactgtctaaggacaaactgacgtgaaccctatgatctaaggtgatctgttttatgtcttacactcaaaatctgaccgcataatcaatcacgatatttgcatttttaaccgttgcaagcggtacttttgtctgattttctacaattttattcagtaaaattcaatagacagaaaaagcgagtcattatggcattttaagagaaaaatagaaaggcaaaagtaaataacgtaccataaataacattgaatgtattttatacaatgtttgcggctactaacgaaaaaggtagtctctctaataacttctgatgaatcccgccaaatgccccattactcatcactaaaatatgatccgttggtttagcttccttgacaatcaattccactaattcatctaggcttgtcgaccattgtgccggctggcttagtgcatctgtaatcgtgctgacttgccacggaatggtatcgggttgataaacaaagacggcatcagcgtctttcaacgatggggcaatttcctctttgtgaacgcccattttcattgtgtttgaacgaggctctaataccgctaaaatgcgttgttctttacctactttgccacgaagtgcgtcgatggttgctaaaatagcggttgggtggtgagcaaaatcatcataaacggtaacgccgtttacttcccctttgacttctaaacggcggttggcattgataaagctgtttaaacctaaacaggcttgctcaacgcttacccccgcgtgatgtgctgcggcaatcgccattaagccgttgtgcatattgtgagcaccgagcaagttccattccacttcccctgctttttgctgtttatggtaaatcgcaaaatgggagtaatccgaacttaacggctcggcgtaccaatcttgatcttgcccgataaattgttgttcgctataacagcccatttttaaggtgttttggacattttcatctgatgttgccgataaaatgcagccattttgtggcattgtgcggataagatgatggaactggcgttgaattgcttttaaatcatcaaaaatatctgcgtggtcaaaatcaatgttgttgataattaaggtttttggattgtaatgtacgaatttagaacgtttatcaaaaaaggctgaatcatattcgtccgcttcaatcacaaagaaatcgcttgatcctgcacgagcagaaataccaaagttgcctgccacaccgccgattaagaaacccgtatcaatgccagcttgatctaaaatccagcttaacattcccgttgtggtggttttgccgtgtgtgcctgaaacggcaagtacccaacgatctttgagtaaatgatctcttagccattgtggccctgaagtgtatggcaagcggtgatttaagatatgttctacgcaaggattaccacggctaatcgcattgccgataataatcatatcgggaacaggatcgagctgtgcaatatcgtaatgggggataatttcaatgccacttttttccaaaaaggtactcattggtggataaacattggtatctgaccctgtgactttataacctaactctcttgcaataatcgccacgccacccataaaggttccgcagatccctaaaatatgaatatgttgctgtttcatagcattccttacataaaaattgtgaacagtatcacaaaacaaaactttactcgaaaacagggtttcaatgggcgagtataataaagcaaactgtattgaatagctaataaggagataaaaaatgaaaacattaggcgaatttattgttgaacgccaagcagaatatccaggagctacgggggaactcagtggtattctatcttccattcgtttgtctgcaaaaatcattcaccgtgatattaaccgagcaggtttaacccaagatattttaggtgtatctggcgatgaaaacattcagggcgaaacccagatgaagctcgatgtatttgccaacgaaacaatgaaaaaagcattaattgctcgtggcgatgtggcaggatttgcatctgaagaagatgatactttcgtggcgtttgatacagaacgtggtcgaaatgcaaaatacattctaatgacagatccccttgatggttcgtccaacattgatgtgaatgtgtctgtcggaacaatcttttcgatctacaaacgtgtatcaccgattggtacaccagtgacgatggacgattttttacaacctgggcgtaaacaagttgcggcaggctatgtgacctatggttcatcaacaatgttagtttatacgacgggtaatggcgtaaacggctttacctatgatccttctttaggtttgttcattctttctcacccaaatatgaaaatgccgtttgaaggcaaatattattcgattaacgaagggcaatatctcaaattcccagagggcgtgaagaaattcattaaattctgccaagaagaagataaagcaagggggcgcccatactcttctcgttatatcggctcattggtttcagacttccaccgtaacttgttaaaaggcggtatctacatttatccaagtacgaaaaaccacccgaacggtaaattacgcctactttacgaaggcaacccgatggcattcttagctgaacaggctggcggtatggcaacagacggatttaatccgattttagacattaaaccaactgaattacatcaacgtgtgccattctttgtgggttcaacagcaatggtacaaaaagcgggcgagttaatggctgaatttcgctagtaaataatggaaagaaactcaccgcttgtttacgcaagcggtgagttttttatatcattttgttataaagaccacatttttgttctttaccttcagcaaaataatcggtatcttgcttgcaatttttcactctttattggagatattatgaaactaaatactaaattccctctcttagccacgacattattggtttcaactgttgctcaagcagcagataaaacgtttattaactgtgttagccgttcaccaacaggttttagccctgcattagtgatggatggtatttcttataatgccagttcacaacaagtctataaccgtcttgttgagtttaaacgtggttcaacagatattgagccagcgcttgcagaaagctggacagtgagtgatgatggtttaacttatacctttaatttgcgtaaaggtgtgaaattccactcaaataaagagtttaccccaagccgtgattttaatgcggacgatgtggtgttttcattccaacgtcagttagatccaaatcacccatatcacaatgtatctaaagcaacttatccgtatttcaaagcaatgaaattcccaacattgttgaaatcagtggaaaaagttgatgatcatacagtgaaaattaccttaaaccgtcaagatgcaacattcttagcgagtttaggtatggactttatctcgatttattcagcggaatatgcggataaaatgttagcggcaggcaaaccagaaaccattgatacaacacctattggtactggtccgtttgtgtttgcaggctatcaagtggatcaaaaaagtcgctatttcgcacataaagagtattggaaagggaaagctgatattgaccgcttgatctttgaaattgtccctgatgcaacggctcgttatgcaaaattacaagcgggtgcttgtgacttaattgacttcccaaatgctgcagatcttgagaagatgaaaaccgatccgaaagtgaatttactttctcaatcagggttgaatattgcttatattgcgttcaatactgaaaaagcaccgttcgataatgtgaaagtacgccaagcgttaaactatgcggtggataaaaatgcgatcattgatgccgtttatcgtggtgcaggtgtggcggcgaaaaacccacttccaccaacaatttggggctataacaacgaaatcactggttatgaatataacccagaaaaagcaaaacagttattaaaagaagctggctttgaaaatggttttgaaacggatatttgggtacagcctgtggtgcgtgcttctaacccgaacccacgtcgtatggcggaattagtgcaaagcgactgggaaaaagtgggcgtgaaatcaaaactggttagctatgagtggggcgactacattaagcgtactaaagcaggtgaattaacagctggtacttacggttggtcgggagataatggtgatcctgataacttcttatcgccattattcggtagtgaaaacgtgggtaacagtaactacgctcgcttcaaaaatcctgaattagatgcgttattacacaaagcggttggtttatctgacaaggcagagcgtgccaaaatttatgaacaagcacaggtattgttaaaagaacaagccccttggatcaacgtagcacactcaattaactttgccccaacaagtaaacgtgttcaagactataaacaaagcccatttggttatacttacttatatggtacgaagttggcggattaatctgtcttaacaggaaagggaagcaataagcttcctttttcatttcattaccgatgagaagataaatcagctataattcttcccaaaaataaagaaataaaatacacatcttaaataagggagaatatatggaaattaaatcgtcacggaaacgcttaaccctcaatgatattgcacaacttgcgggtgtatcaaaaaccacagcaagtatgatcttaaatgggcaggcagaacaatttcgcattaagcctgaaacccgccaaaaagttgaagaaatcgcaaaacagcacggttatcgtgcaaatgcttatgcaaaagcacttaaactacgtcgcaccaatgttattggtctggtcattcctgatttaaccaattatggctttgcctctacagcaaagactttagagaaattgtgccgagagaatggtttgtacttagtcattgcttgttctgatgacaatcctcaacaggagaaacaagcgatagatcgtttacttgaccgtcaaattgatctcttaattaccgctccaacacatcaagatccaaaatactataaatccgtattaaagcacactcttctattacaacttgaccgctatgttcctcaacttgaattaggttatgtgattagtgctgataccgaaaaaattgcagaactagtatctctaacgatccaacgctatcaacttaaagaatatttttattttggcggtcaatgctcactttctcctagtgaatctcgtttagctggttttcgccaaggcttaaaacaaggtaacttacaagaagaaagcggttggattttacataaaaattaccaacctgaatcaggttatcagttgatggcagagctggttgaacgtttagggcgtttgcctgaagcagtatttaccgcgtcttataccattttggaaggtgttctacgttacctcactgaacacaagcaaatggataaactgttgaacggtcaattacatttagccacttttgatgatcacgatttacttaacgctctgccgtttcatattcattcgattaaacagaatcatcaacaaattgcattttcgctgtttaatctgatacgccaaaagttgcaaggaaagccaatggagcagttaaaagtagaatgtgaaattatttggagaagataagatgattacaagtatagcctagatttttctccctacaataatagttaatccattcttgtcttcagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatttcgggggcaaacagctggactgaaatcaaactttttggcgaattacatttggattggttgcgaaaatatcgtccttttgagtgtggcattcctgtcgatgatactatcgctcgtgtaataaaacgcattgagccacaagcatttaatgaggtttttcttaattttatcaatgagatacgcacacaacaaggacgtgaagtgattgcgattgatggcaagacacttcgtcatagtttcaatccggaaacccaaagtgctttgcacagtgtgacggtgtggagccagtctcgtggtttgattttgtcgcagaaaaaatcctcgggtaagcaaaatgagcagcaggcggtgatggaaattatcgatagtttttgcttaaaaaatgccgttgtaacggtggatgcgatgaatacacagaagaaaattgcggagaaaatcatcgaaaagaaaggggattatgtgatgccgttgaagaaaaatcaccgtcaatttcagtcggaagtggaggcgtattttcacaaaatcagccgagattgccccgaaatgcttgagacgtatgaggaggtaaatgcggaacgtagtcgaattgatgagcgttactaccgtaagctgaaagtgagtgattggctgagcaaagcggaggaatggaaggggataaaatcggtgttggaggtgtgtcgcaagcggtcagataatggcaaagaatcacaagaaaaagtcttttatatcagtagtttggatgttgatgttcaaatattggcgaagtgcgtgcgagggcattgggaagtggaaaacaaagcccattgggtgctagatgtggtctataaagaagacgaatgtgctgtgactgatgaatggggtgcggaaaatctggcaattttgcgtcgattagcgttgaacttggtacgattacacccgaaaaagcagagtatgaaagggaaattgaccgctgctggttggtcagatgaatttcgagatgagctgttgctcggtgtgtaggttgaaaaatggacaacatatgcggttgccctgttcttgtcttactatattgtaaacaaaaatttccaaaattcttttttcggagtatcataagcggacagatcaaaggcttattttacaaaaggaagagaagatgcgatttgcgattgagtgtattgaacgtgtgggcgttgctcaagatattttaagtttattggcaacgcaaggcataaatttagaaggaatcgaactgcaaaaattaggcgaaaaagggcttgtttatttgcgtactgaagcaatggagactagccagcaagctaattttgtcaaacagttgaagaaaattccaagtattactgctgttcaagaaattcatcatcttccacaagaacgtaaaaatcttgagttgagagccttaattgaggcgttgcctaatcctgttttatcgcttgatctcaacggtaaaattgcctttgctaattctcaagcctgtaaagttttattaccgatttatcgccagtcgctacctaagaaaaaacaagagcaaattctttctcttgaaggcgttgatctcaacgaaattatcgtcaatctcaatcgcaccaaatggtatcagtgggttttgcaacaagggcgttctattttaccgacaacgttacagccaatttctcaccctattcaatttaatgatcaagtatggcgaatggatttactgccgattgaattgtgggaggcggcacaaaaccgaccgcttgggtatgttgttactctgcaatctcagcaaacaatgcaactcgatttacgtcaatttatggcaaatcaaaacagtgatttcgatcatattttgacgaagagtgccaaaatgaaagcggtgattgaacaagccaagaaatttgcgacactcaatgtgcctttgcttattcaaggcgaaacgggaacaggtaaagatttgtttgccaaagcgtgccaccaatttagttttcgtcgggatcaaaaattcattgccgttaattgtgctggattgcctgaagaagaggctgagagcgaaatgtttggacatcacggtggcgaccgtacgcacgttggcttttttgagtatgccaatggcggaacagtattgctcgactcggttgcagaactatcccttgaaatgcaaggcaaattattacgttttttgaatgatggatcatttcgccgcgtaggtgaagataaagaaattcaagttgatgtgcgtgttatttgtacatcacaaaaaccgcttgcgaccttagttacggaaggaaaagtacgcgaagatttataccatcgcttgaatgtgcttaccttgaatttaccgccgttgcgtgaaagacaaggggatttaatgctactgaccgatcactttattacccaaatcagtcagcaactaggcattcgtaaaccgctttacgatgaacattttatcaaagctatgcaagcctatcattggtctggaaatttacgcgaactttataatgcaatttatcgagcttgctctttagctaccgatcaacttaaatcgagtgatcttaacttgcctgaaacggtaccaagccattttgaaatttcacatttagagcaaggttcattagaagagctggttaatcgttttgaagcctcactgttacgcaagttctatacggaatatccaagtacgcgtaaattggctcaacgcttaggtgtttcacatactgcaattgccaataaattgcggagttatgggatcagcaaatgatgaaacaacttatgctatggggatttgcatttttaggcacatatcttaccgcttacgcatctcctaaaattccacaagcgttactgacagacagtctggtttactgtaccagtgcctctggtttttcttttaatcctcaaaaagccgatgttggttcaaatatgaatgtcgttacagaacagatttacgacaaactgattgaatttgatcccgaacaaaaccagctgaagtctgcccttgcagaacgctttgaaatgagtgaggacggtttaaccattacgttatatttacgtaaaaaagtctcttttcatcatacaaaatggtttacgccaacacgctatttgacaagtgaagatgtgatcttttctttaaatcgaattttaggcaaagttggggaactgcctgagcttaatcgagaagtacaacatcaagttcgtcaccgaattgcagaccgcacccatttctcttattttgaaagtgtcgatcttgctaatcagatcgtcgagatttcagcgccttcatcgcatatcgttaaaattcgtttggcacagcccgatagctcaattttggcccatcttgccagtcagtatgcggtgattttatcgaaagagtatgccttacaactcaatgccgatgataatttaatgcaactcgatattctgcctgttggcacgggggtatatcagcttgataattatgtacaaaacgattttgttcgcttacagcctaatcctcgctattggggcaaaaaagccaatatcagtaatttagtggtggatttctctacctctggcacagggagaatggcaaagtttttgaacaacgagtgcgatatttctgcctttccagaaccaagtcagctctctattttggataaaacgcaaggctatgtaattgaaacggctggggcaaaccttgcctttttagcctttaatttccgccaagataaaatgaaagatccagcattacgccaaaaaattgcgacaagtattgatcgtgagcgtctggcgcgtattctgttttacggcgttgctgaagtaccacaaaatgtactgccgaaggcgttgtatgcgcaagaaaatccaacaagctacccttattatccgcctgatacgagtaaaaaagtggaggaaacagaccgcttaacactgtgggtaattgatgaaaaacgtgtttatcacttgcacccgttaaaaatggcggaatatctgcgagcagagttagcgaaagtgggaattacgctcaatgttcgccaagtgagccgagcctacttaactcagcaacttgaaaatcatcaggcagactatgatttaattctaagtggttggttagccaataattttgatcctgatagttttctctcttcgattttaagttgtcgcttgcaagatgcggtgaccaatctatcgaattggtgtagcgtggaatttgatgaattgcttaaattagcaagaaccgctgaagatccacaaagccgaatgcaatattatcaacaacttcaaactctacttgaagaacgcttaccgctgttacctttggtgaatgtcaaacggttgttagttgccaataacagcgttaagaatgtcaaaatcagtgcgtttgggcaggttaaattatctgacattaaggtgaaataaaatgttgttcgttcttattcgtaagctcttgttaatcatcatttcactgatgattttatcgcttatcagttattttattttgctgagaaatccgcattattctgtcattgaacaaggcttctcaggctatgcaatttatttgcaacaattgcttgaagggaatttaggcgttagcgaaatgacaggtgagcctttaacgaaattaattttaaatgtctttccagccacgatctcgctctgtttatcggctatgttactttcgctgatgctaggcattccgcttggcttttttgcggcgctacaacggcaaaatatgattggcaaactgttaggctcactggggtcattaagccttgctgtgcctgtattttggcttgccattgtcttattggcgtatgcttctagccatcattgggcaatttcagctgtcggcgaactccaccccatttatgcggtgccaacaatcacaggcgttaaaattttagatatttttctttcagatgcaccacataaattaaaaatgatgcaaagcgccttgcatcatcttgcactgcctacccttgtattagctgtgccagcgacgttagaaattatccgaatgacaaaacaacgtacggaatatgtgctgaaacaaaattatgtcaaagtcgctcgtacacgaggctggtcgccacttaaaatctggtgggtgcatattttacgcaataccttgcctccacttattccgatgatcgcaagaaatatcactttaattttcgcctttgctatgcttgtcgaaaatgtggtgagctggggaggcgtaggacgttggatagttaattcccttgcactaaaagattacaatgcgatttccgcaggcgtgcttgcgattggtatttttgttctcagtgtggatttactggcaagcctattaactaccctacttgacccatcgcagaaaaaagattggtatgtcaaggtataagaaacaatggggacttttaggggtgctatatctcgtgctgttaaacattttttactctgctaatacgctttgttttctgcatttaatttagaaaataaagtttgttgtgtctcattgtatctactcattcttccgtgcatttgctatacttttatccctttaatttatttattcatcggatactgtaatgcaattaaaatcctacccagcgccaacctacgcacaacgtgccaaaatcgcgtttcaatatatgatgccacagctatatttaacccaaaccgcaggctggctggcggaacgtaaatggggggcaatcactcatttcatcatcaatgtttttgcgaaaaaataccaagtcaatttagcagaagccgaaaagactaatgcttctgattatgtatcatttaatgaattttttattcgtccattaaaggaaaatgctcgcccgattaaccaagatccgcaagcactctgtttacctgcggacggttgtgtgagtgagttgggtaaaattgaagagaaccaattattacaagcgaaaggtcaccaatttagtttagaaacattacttgctaatgatcttaatctggcagataaattcaaaaacggcaattttattaccacttatttatcgccaagagattatcatcgtgtgcatatgccgtgcgatgccaccttgcgtaaaatgatctatgtgcctggtgagctgttttcggttaatccatttttagcagaacacgttccaaatctttttgcgcgtaacgaacgtctgatttgtgaatttgaaacggcatttgggcctatggtgcaaatccttgtaggggcaactattaccgccagtatgagtactgtttgggcaggagttatcaatccgccaagagcaaaagaagtgacagtttacgaatatctccctacaggcgaaaccgcagtacatttgaaaaaagggcaagaaatgggggcattccgtttaggctctacggtgattaatttgttcccgaaaggtgctgtggagttggaagctcacttaaaagcaggcgaaccaaccaaaatgggtgaacgtttaggtaaaatcaatctctaaaaattagggcgttcatatacgccctttgttatgtgtaaggaaaacagatgaaagccaagttacttattccactgattgtttttttagggttaattattacctttactattcagcttcaacgcaatgccaatggagaagatccaaaagcacttgagtctgctctcgtaggtaaaacgatcccagaatttaagttagaatcgttacacgaagcaacacagatgttagattcatctgtggttaaaacaggaacgccacgcttattaaacgtatgggcaacctggtgtccaacttgttttgctgaacaccaatttttaactgttcttgctaaacaaggggttgaaattgttgggatagattataaagatgagcgtgctaaggccttaaaatttttaaaagattatggtgatccttacaaagccattgtttatgatccaaaaggctctttagggttagatttaggggtttatggtgcgcctgaaacctttattattgatggtaacggtaaaattcattaccgccacacaggagatgtgaatgaaaaagtgtggaatgaagtgctaaaaccaatgtatgagaaattgaagtaatggctataaagaaattatttgcactcttattgcttgtctccgcattaagcatagcttcgacggatattcagcaatttgataatgcacagcaagaatctgattatcgtgcgttaatccaagagctacgttgtccccaatgtcaaaataacaatattgcagattcaaatgcaaccattgcgacagatatgcgtaacaaaacccttgagctattgaaacaaggtaaaagtaaagatgaagtcgttggctatatggtggaacgttatggtaatttcgttacctatgatccccctatcacaccagcgaccattctactctggcttatgccgttattattaattggggtaggtttaggcattatgtttaaacgtaaaaagcgtgtacaagcggtcagttctgagcagaaaaatgcaaatgtggttgatacagctcgccttaatcagattttaaacgaaaaggataaataatgaatttttggattttagtcacgattattacgctgattattggcgtagtggcgttctaccctttattgaaacagcgtcaaaatttaagcacacaaaagcgagatagcctcaataaagccttctactttgaccgtttaaaggaagtggaacaagaagcggaagcaggtattattgaagatagcgagcagacgaagctcgaacttcaacaaagcctgcttgacgatattcctgagcatcaaacacaagcggtaagttcggcaaaatcatttggacatcttggcaaattatggtttatcgccttgattttattgattggcggtattagtgctgggatctattggaacatcggttcgtggtttagtggcacaatgcttgaaatgagccacaaaaagcttgattatttttatgaaagagtaaaaacggaagaaaccgatcccctttcagaacaagagctgaaccaatttgcaatggcactacgtgttgagctacaaaaaaatccgaatgacgataaacattggtttatgctaggtcagttaggaatggcgttggataatggacagctagctcttgatagttttgctaaagcgagcaagctaaaaccagagaatatgcagtataagttacgtcacgctgaaattttattgttctctgaagacccaaaagataaatcgcaaggtgagttattgctcaaagaagtgattagggcagatcatacaaataccaatgccttgagcttattggctttccgtgcgtttgaacaggaagactataaaatggcggcaatgacgtggggaatgatgttgaagttaatgcctgaagatgatcctcgtcgccctacgattgagcgtagtattcaatctgcgttgtcgatgataaaaccaggagaaataaaagccccctaactcaccgcttgttattttatagactagatgtaatgcaaaaacctctcgcaatttttttaatggggccaacggcatcggggaaaaccgatcttgccattgccctacgccagcagattcctgttgaggtaatcagtgttgattccgccttgatttataaaggtatggatataggcacggctaagccgagtaaggctgaactcgaacttaccccccatcgtttaattgatattcttgacccatcagaaagttattctgttatgaattttcgtgaagatgcgttacgagaaatggcagatattacggctcaaggtaaaatccccttgttggtggggggtacaatgctttattacaaagcattgcttgatggcttgtcgccattgccttcggcagatccagatattcgggcagaaattgaagcaaaagcagagcaaatcggttgggcaggtttacatcaagaactggttaatatcgacccgatttcggctaagcggatcaaccctaatgatagccagcgtattaatcgggcgttagaggtcttttatatttcgggaaaaacaatgacggaactcaccgctcaacaaggcgaaggtattccttatgagataatgcagtttgcgatagctccccaagagcgagctgtgctacatcaacggattgaacaacgttttcataaaatgatcgatttaggctttgaacaagaagttcgacagctttatcaacggggcgatttaaatgttgatctgccttctattcgctgtgtcggttatcgacaaatgtgggaatatttggaaggtcaaacttctcttgatgaagcaatctttaagggaatttgtgcaactcgtcagcttgctaaacgccaaatcacttggctaagaggttggacgagtgagctagaatggcttgatagtttagatcctgaaaattcttataaaaaaatgatcgaaaaagtacagcaaaagcatttgaaactgtggtaatatcgcaatgcctttggcaaagcattaaacaacaataattagaaggaacataaaatggcaaaaggtcaatctttacaagatccatacttaaatgcacttcgccgtgaacggattccagtttccatttacctcgtgaatggcattaaattacaaggtcaaattgagtctttcgatcaattcgttattttattaaaaaacacagtgagtcaaatggtttacaagcacgcaatttcaaccgttgtgccagctcgtgcgatttctcacaacaataactctaaccacgctcatcaagccgcaccagtgcaatctgctgaagtggtagagaaagtggaataattttattactacattagacctcttgaatgaaccaaacaccgcaaattctgtgtttggttttccgttgcctgaaaaaacacaaaacacgcctgacaaagagcgtgctattgtagtacatctttatctctctcaaactaaagatgtggaaaatctgatggaatttcaaactcttgccgagtccgcaggggtagaggttgtcgctacattgacaaccacacgttccgcaccccatatcaaatactatgttggtcaaggtaaagcccaagaaattgcggatgcaatcaaagattttgatgcgaccgtcgttttaattaatcaccaactcagccctgctcaaacacgtaatctacaatccctttgcgattgccgagtggtggatcgtacaggcttgattttggatatttttgcccaaagagcaagatctcacgaaggtaagttacaagtcgagctggcacagcttcgccatttatccactcgcttagtccgccgtttaggtaaccaagatcaacaaaaaggcggtgcggtaggcttacgaggcccaggggaaacccagttagaaacagatcgccgtttaattaaagtgcgtattcagcagttacaaaaccgcttggaaaaggtaagtaaacagcgtgatcagaaccgcaaaactcgtcaaaaagcagacattccaaccatttcccttgtgggttataccaacgcaggtaaatcaaccctatttaatgtgattactgatgcaggtgtttatgcggcagatcaactgtttgctacccttgacccgacattaagacgaattcaaattcaagatgttggcacagcgattttggcagataccgttggctttattcgctttttgccccacgatttagtttctgcgtttaaatccaccctacaagaaaccacagaagcgacattgttgctacacgttattgatggtgcagacgaccgtaaaaatgaaaatattgatgcagttaatcaagtgttagatgagattgaagcattagaaattccgaccttgctcgtgtataacaaggtggatcgcttggacagcattgagccacatatcgaatacaacgatgacggcaaacctgtggcggtttatctttcggcacaacaaaatcaaggcattgatctgctatttgaagcaatgcgagtcagacttaaaaacgagctggtctgtgaaagagtactgctacccacaacaagcggtcagatttacactaaattttaccaacagcaatgtatcaaatcagagcgtttcaccgaatttggcgatcgtttagtggaaattgaagtcgataaaattcaatggcaaaagtggcttaaacaataccctgaactaacggaatttgttgagtttgcgaaatgggaagcagagagttaatattgacctaaaaacaaaatatcgagcgtatctcaccgcttggttaaggaaataagatgacgaaacaattcaaattaatcggttttgacctagatggaacgctagtcaatagcctgcccgatttagccttatcgcttaactctgccttcgccgaagttggcttgccacaagcctctgaagagcttgttctgacttggatcggcaatggagctgatgtgctttttgcgaaaggaatggaatggacaggaaaagcagacgaattttcacaggacgaattagcccaaattaaacgccgatttggatatttttatggcgaaaatgtctgcaacatcagcaaactctatccaaatgttaaagaaacattagaaacacttaaaacacagggctatattttagccgtagtcacaaacaaaccaactaaacacgttttacctgtgttgcaagcctttaaaatcgatcatctcttttctgaggctcttggtggacaatctctgcctcaaataaaaccacacccagccccactttattacctttgtggcaaatttggtttatatccccacgaaatgttatttgtcggcgattctaaaaacgatattttggcagcgaaagcggctggttgtaaaagcgtaggtttaacctatggctataactacaacattcccattagtgaatctgagcctgattatgtttgtgaggattttgctgagattttgaacgtcatacaccagtaactagtaaggtagcatttgaataataggcatagtaggcaaatttattacccatctatcaaaaattattggcatagtagacaagagtgttgttttttgcaaactatgcctctaatggacaaacgttgaacagttctaatggaacagtgatatttttcggataattgtttataggtttgttttcctattgtgtaatcatctattggatttaatttatttgtggaagaaaatgttttatggcaggacgaacaaaagtatctctgaatattatttttatttccatacttttggatgttgttcttaaggcaaaaaggacaggtttttattcatatttcaaaaagtggcttaaagccttatagtacaaggctttaagccactttttaccaacgcttttgtctactatgcctaatcatatctaatgatatcagtggtaaaacatttaataatgtaataatcattatatctgtttttgattttcagcccaccaagctgcgcctatcaatcctgcatcttgagcataataagcaggaacaacttcaggacgataaatttcaggcatttcggaaaggaaatgggttactctggctaaataaccttctgctaatccaacacttccgccaagggtaattcgttgaatgtctaagttaattttgagatcagcaattaaatgagcaatcgcttttgcagatttatccactaaagcagccgcttgtggatcgcctgctctgaagcgtgcaaacacttctggcggttcgcaagggttatcccatttggctgcatcacgagcaatcgcacgcccagcggcaaccgcttcgacacagccgacacgtccacagccacacacttccccatttggatcagcaaggctatgtccgatatgtccagctacgccgtttgtgccagtaaaaagtttgcgatttaagataataccgccccctacgcctgtcgaaacggtaataaaggcaaaattttcaatgtcatcttgacgtaaaaattcagcacaacccgccgcttgggcatcatttaacagcgtaatcggcttgtccgtgtgtttggcaacgctttgctcaagaggaaagaatgccagattgcctaaatttttcgggttaagtgcggttagaatacccttttgaataattcccgttgaagccaccgaaacctgatcaaatttccctttgaactgcgttaaaatttgtgccaaagcactgtctagagcttctgcacttggattttgtggtgtgtgaatttgtgtacgttccgccacaatcgcatcttttccctttaaggtaacaagagcagcagcgatttttgttccacccacatcaatggctaaacaagcggtcatattaggctcctgttttgcgattatcaatggcggtcacaaaccagctcacaatatgctcaaggcgagttaaagcagagccaacggttacagcataagccccattttcaatcgcaacggcagcaagttcaggggtattgtaacgcccttcagccattacacgacaaccactggcgactaaatcacgcaccagttgtacatctggctcatcaggggtttcaccgcctgtatagcctgacattgtgctaccgattaaatctacgcctaactcttggcagtacataccttctttgtagtttgagcagtccgccattgacattgctcctaactcttggatacgtcttgcacaggcttcaatcgtggttggacgaacacgatctgtaccatcaaaggcaataatatctgcccctgcgtgatacaaatcgtcaatatcttgtaagaatggcgtgatacgaacagggctgtcaggtaaatcacgttttacgatacctacaatcggcacatcaacgactttacgcaccgcttttaaattatcaatgccttcaatacgaagccctgccgctccgccaatgactgatgcttttgccattgccgctacaatctctggcgagtccatcggaccgtcatcaacaggttggcaagaagcaattaaaccattttttaattgttctaaaatttgttgtttggttaatctcgacataaaaactccattagcattaaacaaaaagaaaatttactccaaagcatacccctacaaatgaagtaatgcaatcaatagcattaaaaagtgagagatagatcaaatttttctacaaataaaaaacaaaacggtgaatttattacaaattcaccgttcaagataagtcgttataaaacgagttttaatcgattatttaaaaaattcaacagctaaacgagcaccgactttcgcattatttttcaccagcttgatattcgcttctaagctcttgccttcggtcatttcaacgattttaccgagtaagaatggcgtaatatctttacctataatgcctttttcttcggcttcttttactgcggtatcaataataccgttgatataacttggtgctaattcatcttcttgtggaattgggtttgcaacgaccacgccaccttctaagcctagctgccatttcactttgatcatttcagcaatttcagttaattcttcacacgataacgccaatggtaaaccgctatcacgagtaaagaatgctggtagatttttggttttataaccaacgacaggcacacctttggtttctaaatattctaaggttgcatcaaggtcaaggatagatttcgcccctgcacaaataacggttacgcttgtttgtgctaattcatcaaggtcagcagaaatgtctaatgtggtttcccagcctttatgtacgccacctaatcctcctgttacgaagaatttaatacctgcaaggtgagcacaaatcattgtagaagcaaccgttgttgcccctaattttttagacgcaataatctgtggtaaatcacggcgagaaacttttgcgatccctttgctgctaccaaataactctaattcatcatcagaaagaccaatacggattttgccgtcaatgattgcaatcgtcgcaggtacagcaccgttatcacggataatttgctcaacttcccttgccattgcaacattttgtggatatggcataccgtgagaaataatggtcgattctaaggcaacaatcggcaagccttgagccataccacgttgcacttcatcagataaaataaggtagttattcataataatgctccatttcggtttctaattgagatttggttaaatttggtcgaacagtaaattccgactgaattgtatgataggcgttggttaaaccagctaagatcgccttgtcttgctcataattattaagccaagcataaataaatgctccactaaaagagtcgcctgcacctgtgacatcaatcactttgtggctatccacttttttaacggaataccaacgggtttcatcctgagatgcactcaaaatagctttagaacctgcggttaatacaatttgttttacgccttttgctaacaatattttagcggcttcttcaattttttgaacggtatctaatagcatatctaaataggctgcaagttcccctttattgatgattaagcaacttacaccttgtaaatcttgaggaagacgatccattttcggttcggaaacggcaatcaacaccaaaggaatgtgataaccttcggcacttttgcaaaggtattcaatggtcgcttttgggcaattcagatcagccacaatacaacgagcatttttaattaatgcagcgtgtttattcaaggcttcaggggttaagctgtcataaatcgacatatccgctaagcctagatacatttcgccttctttgtctagtaatgcggtataacagcctgtagattgtccttctacggtaatcacattattcatatccataaactcagacgagaaggatttaattctctcccattcaggatcgttgccaaccgtagaaataaagctcactttctgcccgagtctgcctaaattctcagccacattacgagcaacaccgccaatcgttgttgtggaatttactgggtttgacgtataacctcgaagttcttcgtccgttttaatttttttatcaacattcgccgcaccaatacataaaatagcgctacgctcattaagaacataagctctgcctaataaatattctttttttattagggcggaaatgatgttggcaatcgctgaacgagataatcccatatattcagcgagttcttgctgtgaaatgaaagggttttgacgtattaaatctaaaatcgttttttcattctgattcattgccgaactccattaggacaaatgttttaatgaaaggacacttgtcatattattaaattcattggacatagcgtcaatgtctttttcaaaaatttgtgaacaagctcacaaaaataaaggctgaatcccgttcagccttatagtattgcaaaaaatttgaagaatcttaccgcttgtattattgaagtcgtttaatcgcatcaatcacgagatcccaaaaacgctctcgatctaaaacttttgccacataagtgttacattcttttggcggataacggaaatctgctaccgtcattccaagtgtatgtgttcctgttaattcaatattcacagggactttttgtgtttcgataagcgtcggatcaatcacataagctacagcacaaggatcgtgaacaggtggataatcaaacccttgagcctgtttatacattttgccgaagaagtctaacagctccaccacaaatttggctaaagcgtttcgagaaactttttccaaggtttgattgccaaccaccgttgttacagccaataaatcaatatctggattgccgtaagcaagcaaaatggcaatagcatcatcgtgtccaggatcgcaatccaaaataatttttttacgcatattatcttcctttagttcagtaaaaattaccgtgggtaaactacaataactctaactctataaggtgtaaaagaagctggcgtgaaaaaatgagagctacttcacatttttgataaataaagtccattttctgtcaatttattttttaactatgtaaaaagttaaagatcttagtttgaaaacttggtatattgtgcagcccatcatttttgatgagttagttgttataatcactataacatttatcatatatctcttctctttctttgaatggagtccttaaatgggtacgttaaatagtttattgggtatagttgttctactaggaatagcttttcttttgtcaaataacaaaagagcaattaacttccgcacagtttttggtgcattagcttcacaaatcggtattgccgcattaattctttacgttccagtgggtcgtaatgcattaggtgcaatggcagagggggttgctaaagtgattagctatggtaacgaaggcgttgctttcttatttggcggtcttgttagcgataaaatgtttgaagtctttggaggcggtggtttcgtcttcgcattcagagttcttcctatcattgtcttcttctctgcattaatttcattactttactatgttggaattatgcaatgggtcatcaaaatcattggtggtggcttacaaaaagtacttggtacatctcaagcggaatcaatgtcagcagctgcgaatattttcgcaggtcaatcagaagcaccattagtggttaaaccttacatcagcaaaatgactgagtcagaactttttgcagtaatgtgtggtggtttagcttctatcgcaggttctataatggcaggttacgcaggtatgggggttccacttacatacttgattgcggcatcatttatggctgcacctgcaggtcttttattcgctaaaattattcttccacaaacagaaaaattcaatgacagcattgagaacgttgaattagaaaaaccagcaaacgtattagatgcagctgctgctggtgcaagctcaggtatgcacttagcattaaacgtaggtgcaatgttaatttcgttcattgcattaattgcattaatcaatggtgttttaggcgctgtcggtggctggttcggttatgaaggtctaaacttaggtctaattcttggttggatatttaaaccattagcttgggcaatcggtgttccttggaatgaagctgaagtcgctggtcaaatgatcggtcttaaattagcgatcaatgagttcgtgggttacttagaatttgctaaatacttaggccccgaagctccaatggcattaacagacaaaactaaagctatcgttactttcgcactttgtggttttgcaaactttagctctatcgcaatcttaatcggtagtttaggttctatggcaccaaatcgtcgtggtgatgtagctcgcttaggtatcaaagcggtaattgcaggttctcttgcaaacttaatgagtgctgcgattgcaggtctatttatcggaattggtggtgcggtttaacactctcaattcttgaacgaaacaccacaggaaactgtggtgttgtcgtttatggcaaagttaaacgattgctttaagtaaggaataaagaatgagtttaaaatctattgcaaaacaagccttatctttaatggatttaaccacattaaatgataatgacaccgatgaaaaagtggtaacattatgccaacaagggaatacgccatttggtacgcctgcggcggtgtgtgtttatccacgttttgtgcctattgcacgcaaaaccttaaaagcacaaggtacagaacaagttaaaattgcgactgtcaccaatttccctcacggtaacgatgatattgacattgcagtggcagaaaccaaagctgcggtggcttatggtgctgatgaagtcgatgtggttttcccatatcgtgcattgatcgcaggtaatgaacaagtcggttttgagcttgtcaaacagtgtaaagcggcctgttctgccaataatgttgcattaaaagtgattattgaatcaggcgagctgaaaacagcggaattaattcgtaaagcgagtgagatttcaattaaagcaggggcagattttatcaaaacatcaacgggtaaagtgcctgtgaatgctacccttgaatctgctcatattatgctagaaaccattcgtgatttaggtgttgcagatagcgttggttttaaagccgctggcggtgtaaaaaccaccgaagaagcagagcagtacctcgcattaactgctgaaattttaggacaagattggattaaccaagctcatttccgctttggtgcatctagtttattagcgaatttacttgctacattaaacgatgaacaagtaaatcaaaatgtaacgggatattaatctctcaacaaacaacgaggaacagactatgactccacatattaatgcaccagcaggtgcatttgccgatgttgtattaatgccaggtgacccacttcgtgctaaatatatcgctgaaactttcttagaaaatgcagaacaagtcactaatgtccgtaatatgctcggttatactggaacttacaaaggtcgtcgtatttctgtaatgggacacggtatgggtattccatcttgctcaatctatgcgaaagaattaatcaccgaatacggtgtaaaaaaaattattcgtgtaggttcttgtggtgcagtacgccaagacgtgaaattacgcgaagtcattatcggtgttggtgcttgtactgactctaaagtaaaccgtatccgtttcaaagacaacgactttgcggcaattgctgactttgatcttactttagcggctgtacaagcagcaaaagcgaaaggcatcaatgtgcgtgtaggtaacctttactctgcagatcttttctacactccagatgtagaaatgtttgatgtaatggaaaaatacggtatcttaggtgttgagatggaagcggctggtatctacggcgttgctgcagaatttggtgcaaaagcattaaccatctgtactgtttcagaccatatccgtacgcacgaacaaactaccgcagaagagcgtcaattaaccttcaacgatatgattgaaattgcgttagagtctgtgttgattggtgatcagcaaggttaattaaaggcataccccctgattgattaatccgcatttttgtgaaatgaagtattacaagaatgcggattttatcataactgtgccgtaaagttctttccttcagagcggagatataagatataaacggtgtgggtcgtttcaaatctaattaatcaggtatttgttgttgcttgatgtattggtgaataatcgaatgggggaaccaccgcggctgccagcaaatcgtgtttaatttcagtttcttcttttcatagatcaaatataaaatgtggaaaaatcacgctctaaactttgttaatgcaattacgcaaagcctttaagttcgagataatgcccaacggcgaggaaatccgcataattaaacagttctgcggctatgctagggcatagtagacaaaatggctgctaatttcgtgaaaactatgcctatatgacaaagtggtcgctaatatttaaggaatacaaacattagcaactatttcatccgcccatgtgttcaacatgagtaaaaagaatttaacagacaaagtatgtgattgatataagattcatttaaattcataacgaggaattgtttctagtctattcatctcatttatatgcacacggccccccactgttgcatgagcatcgtacttcctatttattgttactaattcaccattgtctttttttatagtaagtttaactgaatcaaaagatagatattcgctggttacaatagttgcattaccttcagatgtatatttttcagccgtacacgctactgatataatgcctattaataaaatactagataactttttcatataagccctttgtataaaataagccaattttaaagaagtgacacatttaaatcataagggtgcaacttaagacagcaaaaattctgataagttgcatttttgagtgaaattgccacacttggattaggtaaacgttcgccttcgacttgtggttggctgattttgatctttaattcgggattagcttgcaaagaaaattgctcatctatccgcttacaccactgctcaacgttctcgttttcgtacattgggataataatttcaatatgctcccagccttcttctggatagcttttacctttagggaacggcaactcaatcacggaaactgcctgtccgcaaaaatgcactggctgatttagagtaaacaaacctatcgggcgaccattaacttcactctcttttaataaggttgagccagtcagcagcattgctttccattggttagcgacttcatcactattcattcgcaccgccagatgatcgatctgatattggctcaaatcaatctgagcaatcttagcaatctgcgctatttttcgctcaaattcagcaagttcaccaaaacaagcggttagatttgtgaaaaagtttgcaaattcggagcatttatcagtattttttagtatcattgcacacattttttagtattgaaaataggtataaacgtgaatattcaacacattctatcggaaaaaatcaagcaagcaatgattgtcgcaggggcagagcaaaatgttgagccattagtgcgtcaatcaggcaaagtccaattcggtgattatcaagcgaacggcattatgggggcagcaaaaaaattaggcttaaacccgcgtgaatttgctcaaaaagtagtggataacgttgatttaaacggcattgcagaaaaattagaaatcgcaggcccaggttttatcaacattttcttagccccaacttggttagctcaacaaacagaaaacgcattcagtggcgataaattaggcattaacttaaatcaagctcaaacggtggtggtcgattattcatcaccaaacgttgctaaagagatgcacgttgggcatttacgttccaccattatcggcgacggcgtagtgcgtgccttagaatttttaggcaacaaagttattcgtgctaaccacgtcggcgactggggaacgcaatttggtatgctgattgcttacctagaaaaaatggaaaacgaacacgcgtccgaaatggagttaagtgatcttgaagccttttatcgcacagcaaaagagcattatgatagtgatgaagtctttgcggaaaaagctcgaaattatgtggtgaaattgcaaagtggcgacgattattgccgtacgatgtggaagaagttggtaaacatcacaatgcaacaaaaccaacataactacaaccgcttgaatgtgacgcttactgaaaacgatgtaatgggcgagagcctttacaatccaatgttgcctgaaattgtggcggatctaaaagctcaaggtttagccgttgaagatgatggggcgttagtggttttccttgacgaatttaaaaataaagacggcgacccaatgggcgtgatcgtgcagaaaaaagatggcggtttcctttacaccaccaccgatattgctgctgccaaataccgctttgagaccttaaaagcagatcgtgcgttagtcttttccgacactcgccaaagccaacatatgcaacaggcttggttaatcactcgtaaagcaggttatgtgccggacagcttcagccttgaacatcacaacttcggaatgatgttaggcaaagatggcaaaccattcaaaacccgtacaggtggcacggttaaattagcggatttacttgatgaagccgttgagcgtgcagaaaaattaattgcagaaaaaaatccagatttaaccgcttgcgaaaaacaagctgtagtggaagccgtggcaatcggggcggtgaagtactccgatctcagcaaaaaccgtaccacagactatgtatttgactgggataatatgttgagctttgaaggcaacaccgcaccttatatgcaatatgcctatacccgtgtgcgttcgatcttcagtcgtgcagggatcgacccgaacagcttaacggccaatatcgttttaatcgacgaaaaagaacgcaaccttgcgattaaattattgcagtttgaagaagccgtgacggtggttgccaaagacggcacaccgcacgttctctgccaatatctctatgaattagcaggtattttctctagcttctacgaagcctgcccgatacttaatgccgaagaaagtattaagcaaagtcgcttgaaactcgctcacttaacggcaaaaaccttaaaacaagggttggatctgttgggtattaagacggttgagaagatgtaaggcatagtccgtaaaaaacaacacttttgtctactatgccaacaaaaatatcggcatagtagacaaaatggttgctaaaaagtggcttaaagcctcatagtacaaggctttaagctctctttttgaaacatgaacaaaaaactgcccattttgccaaagtctgaaaataaagaaacatggtataagaaataatattcaacgctataaatgtaatgcctgtaataaaacatttacccttaaaaagaaattaaatccaataagtatttggaatgattattcaataggaaaacaaacctatcaacaacttgctattaaatatcattgttcagtcagaacgattcaaagatatattgataaagcccctaaaacagcattaaatccactactatcacgtgatttaaatattattgtaggatactaccttctttggtcgtgaatttagtattttagtcctgatggattcactttctaaaaaagtggtttaccatcgtgtcatcaaaacgggaaaagatgtttattacagaatagcgtttaattcacttcgtatgaaaagctataaaattcaatcaattgtctgtgatggtagacgtggcttgatgaaagatttatttaatacaccagtacaaatgtgtcaattttatatggtagcgatagtgatgcaaaaattaagaaaaaagcatcaatcacaagcgggtaaagaattaaaaataattgcaaaaacactcacaaaaagctcaaaaatgaattttatcggcgattacattcttggttcataaaacaccaagcatttttaaaagaaaggagtgataaagcgaatgaaaaggctattttccttataaacatcgcaatgtaagaagtgcttatgccagtttaaagcgttatatggattttatttttatctatgaaaaacatactgaattaaatatagaaaagacgacaaatcgcttagaggggctatttagtgaacttaagcgaaaattaaataatcataacggattaacgaaaaatcgtcagatattgtttatacaggattttttaaataaaaagagttgctaacatttagagaaaatagatattagcaactgttttgtccacttggtatagtttttgacgaatcagcaactattttgtctattacaccaaataaaagggctgaatacgattaaatatcgcatccagcccttaagataacaatctaatcttcttaaactaaaaacagattatttgatgattttcgcaacaacacccgcaccaacggtacggccaccttcacggatagcgaaacgtaaaccttcgtccattgcgattgggtgaattaagcttactgtcattttgatgttgtcgcctggcattaccatctcaacaccttctggtaattcgatagtacccgttacgtcagttgtacggaagtagaactgtggacgatagcctttgaagaatggagtatgacgaccaccttcttcttttgataatacgtaaacttctgattcgaagtctgtgtgtggagtgatagaacctggtttcgctaatacttgaccacgttcgatttcttcacgtttggtaccgcgtaataatgcacctacgttctcacccgcacgaccttcgtctaataatttacggaacatctcaacaccagttacagttgttttagttgtatccttgataccaacgatttcaacctcttcacctgctttaatgataccacgctcaacacgacctgttactactgtaccacgacctgaaattgagaatacgtcttcgattggtaataagaatggtttatcaatcgcacgctctggctctggaatgtagttgtctaagtggtttgctaattcaagaattttctcttcccactctggcacgccgtttaacgcttgtaacgctgaaccacgcacgattggtgtgtcatcacctgggaagtcatattgtgaaagaagttcacgaacttccatctcaactaattctaataactcttcatcgtcaaccatatcgcatttgtttaagaatacgatgatgtatggaacacctacttggcgacctaataagatgtgctcacgagtttgtggcattggaccatctgttgctgcaactactaagattgcgccgtccatttgtgccgcaccagtaatcatatttttaacatagtccgcgtgtcctgggcagtcaacgtgtgcatagtgacgtgattctgtgttgtactcaacgtgtgaagtattgatggtaataccacgcgctttctcttctggtgcgttgtcgatttgatcaaacgcacgcgcagcaccaccgaattttttcgcaagaacggttgtgattgctgctgttaaggttgttttaccgtggtcaacgtgaccgattgtacctacgtttacgtggactttatcgccacgattaaattgttctttagccattgtaaagtttcctttgttgatgaaatcccgtagcacgatatgcaccacagggtttagagtaaaaacctattatattgccatttatgttatttatgaacttattttttaaacgatattggtttaaaaaagtccagttaaacaaatatggtcaagatggcattctaccacattaaccaaatttagaaatcaaatacttatttatgctaaggaaaagataaagatagaaagtaatgaagtggtgctgataggcggacttgaaccgccgacctcacccttaccaagggtgcactctaccaactgagctatatcagcgtttggagcgggcagcgggaatcgaacccgcatcattagcttggaaggctaaggtaatagccattatacgatgcccgctgttctaaattcgtctgtcccaaagaaattcaattaaagaaatggtggagggagaaggattcgaaccttcgaaggctgagccaacagatttacagtctgccccctttggccactcgggaatccctccacgataattgaatacttgataacgctagaatggtgccgactaccggaatcgaactggtgacctactgattacaagtcagttgctctacctactgagctaagtcggcgttgcgtcgtaagcaattaaggcgcattatagggatttcgaaaaaccttgcaagcatttttttcaaaaaaattaaaaaatccattctttcgcttgttaaatacgcaaattgctgattttttagatgtttttactaaatgttgtaagataaaatatctactttcattatttctattgtatatttcgggttattaaaaccgtaacaatatgaattatattcagcaaaaatagagaacttggcaatgggcatcactaaaattacgccttttttaacctttaatcgtcagcagtgggctgcattacgaaagtcagtgccgttaaaactgaccgaacaggatttaaaaccgcttttaggttttaatgaagagctttccctagaagaagttagtacaatttatcttccacttgctcgtttgatcaactattacattgatgaaaatctcaaacgccaagaagtgttacataaattcttagacgtagaatcgccgaaagttccctatattatcagcttaacaggcagtgtttctgtcggaaaaagcacttctgctcggatcttacaagccttactgtcagaatggcctgaaaaacgtaaagtagatttaattaccacagatggcttcctctatccattaaaaacgctacaagagcgaaatttaatgaagagaaaaggctttcctgagtcttatgatattcatcgccttattgaatttgtttctgatattaaatcgggcaaacgcaacgtcaaagcccccgtttattcacatctcacttacgacatcatccccgatcaatttaatgaagttgatcagcctgatattgtgattttagaggggctaaatatgttgcaaagtggtatgaactacccacatagcccacatagtgtctttgtttccgattttgttgatttctcaatttatgttgatgctgatgaaaccttattgaaagattggtatatccaccgtttcttaaaattccgtcgcagtgcattctctgatcctaattcttacttccatcactactcaaagttaagtgaacaggaagcaatcacaacagcttcaacaatttgggacgaaattaatggattaaatctacgcaaaaacattttgccaagtcgagagcgagcaaatttgattttagtaaaaggcgaagatcacgccattgaaaccgtcaaattaagaaaatagtaatgagtggctttcagttcaaacagtttttcattgcacacgactgctgtgcaatgaaagtcaatacagacggcattttactgggctcaattgcagatcctagcaatgcacgccacattctcgacttaggcacggggacagggcttattgcaataatgttagcccaacgtaccgctagtgcacaaattactgcacttgaactggaagaaaacgcgtttcaccaagctcaagaaaatgcccaacattgtccgtggaataacagaattgacgtactacaagcgaatataatgacgtggaaatctaccaaaaaattcgaccttatcgtatcgaacccaccttattttgaacatagtctcgcaagccgaaataagcaacgagatcttgcaagagctgtgacttatagccattttgattggctaaaacgggctcaacagtggctaaccccaaatggcagaattagctttattttgcctatcgatgctggaaaaaaattgttggaacaaagccatttattagggctatattgtattgaatactgggaaatctgcacaaaaatcggactatcacctaaacgagttatcctcactttttcaccgcaatatgctgaaatggctttgcagacattgacgatttatgatgaaaatcagcgatatactgctgactttactcagttcacagaaatattttacctaaaagtaaactctaaataataggtatgtggtaagtatgtatctatatgatacacataactagctctaaaattcccttgaaaactttcttatgtgcaccatatgatttaattttcacttcaccaacccaccgcttgcttgtaaatctgcgtggtaggaagagcggacgaaaggcccacaggcggcgtgttcaaagcccatttcgttggctttttcacggaacatatcaaattccgttgggtgaacgtaacgtgccacgggtaaatggtggcgacttggttgtaaatactgccctaatgtcagcattgtgacaccgtgatcacgcaagtcttgcatcacctgtaaaatctcttcgttagtttcccctaaaccgaccataatgcctgatttagttggaatatctgggaaaaccgccttaaattctttgagtagtttgagcgaccattcataatccgcacctggacgaatttctttatacaggcgtggcacgttctcaaggttatggttaaatacatctggcggattttcttttaaaatttcaattgcttgttcaacacgaccacggaaatccggcactaaaatctcaattttaatccctgggtttaacgcacggatctctttcacacattccgcaaaatgccctgcaccacgatcaggcaaatcatcacgatccacagacgtaatcaccacatatttgagcttcatatcctgaatggtttccgccagtttcttcggctcgtctttatctaaaggcaacggcttgccgtgagccacatcgcagaatgggcagcgacgagtacaaattgcacccataatcataaaagttgccgtgccgtggttaaaacattcgtgtaagttcgggcaagaggcttcttcgcacacagagtgcaagccgtggcgacgcataccgtttttgatactttcaatttttgctgagttggctggcagtttaatcttcatccactcaggttttttcagtaattcttggttgggatcgatatttttaacaggaataatggacgttttagctgcatcacgatatttcacgccacgttccattttaaaaggtgtacccattcgataattgtcctatttgttaataatttgttgcttattatagccgagaatttgggtaaagtaatcgaccaatttaggcgaaaccttgtcgcaatcggcttcagcttcagcgacaaaatcagctaattgacacatttccaatcctgcatagccacaaggattgatattgcgaaacggtgttaaatccatctggatattcaatgccagtccgtgaaacgaacagcctttgcgaatgcgtaaaccaagcgaacagattttcttaccgtccacatacaccccgggtgcgtctggtttgggataggcattaattccataatcagcaagggttttcactacacattgttccaatgctgtcaccaaatctcgcacgctcaaatcgttaccttttgtcttgtggcgtttgatgtcgatcagcacatacataatttgctgtcctaaaccgtgataggtaatctgcccaccacgatccgattgtaccacggggatattcgtgggattgagcagatgctcaggtttaccggctgaaccttgagtaaacaccgacgggtgctgaaccagccaaatttcgtcggctgtttgttcatcacggctatcggtaaaatcctgcattttgtgccaaatttcttggtaatcttgcacaccaagttggcgaatgataagttggggcataggttacaataccattctcacgccttcaattttggctaagtcggtatagagtgtttcgacttgttcgatattttcggcttgaatagtgatggatacagagtgataagtgcctttgccactctctttaagagatggattatagtcgcctttaaccactttttgtacttcgctaacgacatcatcgattaaaccttcacgagctacacccacgactttaaaggtgaacgagcaaggaaattcaagtaaatctttgagtttttgttgtggaatatcggctaaatttacgctttttgtttctgtcattttattgtcctttatgaatatgagagcggtgtgattttgcaaaaaatttgcaagatcgcaccgcttgtttgaatggcaccctaaatgagggcaattctgataattacaagggtttaattaaacagacctttaaccgttaaaacgaaccaatcccacgctttgccaaagatacctgcttcttgaacatcgtgcattacttgtaaatcaacactcgccacatctttgccattgagttgataaatcacttttccaacgacctgccctttcactaacggagcttccaaatttgttttttctagggtgtagcgagctttaagttctgctgttttaccttttggaacggtaatgtaactatcttgtaatgtgcctagttgagctttgcttaaatcaccataatacaccgcttgttcaagcacgctttgccctgctgaaagtggtttgacagtttcaaagttagcaaatccccactgtaacagttttttgctttccacttcacgccctttataggttggtacgcccataaccactgagattaaacgggtattactattgtatgctgaggctacaaggttatagcctgcttgatcggtatgtcctgttttcattccatcgacattgatggatttatcccacaataagccattgcggttaggttgggtaattttgttgtaggtaaactctttttctgaataaattttgtactcttcaggcaagtcacgaatgatatgagcgccgataatcgccatatctcttgctgatgagtattgttctgggtggtctaaaccgtgaactgtcgcaaaatgtgtgttctttaaaccaaatttctgcacaaatttattcatactatcaatgaacgtttgctctgaacccgaaatatgctctgcaatcgcaacacaagcatcattacccgacacaacgataatccctttgttcaaatcttcaacagacacctgctgattaacattcaagaacattttagatgagccagggaatttttgtccccaagagttttcggtaacggtgactaaatcgctgtttttgattttacctgttttcaaggcttcaccaactacatagctcgtcatcattttggttaaacttgcaggtgcttggtgttgatctggattaagactggctaatactgcaccagaattgtaatccattaaaatataggtttgtgcattaagttgaggggctggaataccataatcaatatcttgagcataagccatattcatacttgaacaagcaatagcacatagactgaccgttttgagtactttactttttaacatataaaaatcctatctatttttctgaataactgaatacagtgtaacctaaacggttgagctgctgtttaacttgttgagcttcttcagctgaagaaacatcaataatcacttcatatctcttttctttcgtgacaatgtggctattcactgtcgaaatcactttctgtacttttttcgccatacgttcattcttaagttgagtgacctttaacacaaattttggctgagaaacaaccgcttgcggtgtaggttcggtatcggctttaatggcaagtgtttcaccatcccctttcactttaaggttcaacccttcttgttgtgcaatttgatagagtgcttccgcccctttcccgataatatagccttctttatctacctgcatagcttccactcgtacttttgctgtaccagcccccaccataccaatcactttagcagcacctttagataaatcaataatgcgagttttactaaatggcccacgatcattaatccgtactattacttttttgccattgcgtaaatttgttattaaagcataagatcccagcgcaagagttttatgagccgcagtataaccatttttatcaaaaatctcaccgcttgcggttctgcgtccgtggaatttatccgcataataacttgcagttccaacttcgctgtactgacgagaagcttctttacccattaccgtatgcgttgtccccttctcttgataggatttttgattatttgatattttaacgcgttctaaatctgctccttttaccccataaagtttttttgtttgattatcactaggaacggttgtttttgtacttttagtgttagagcttacagctttcttctttacctttttcttagatgttactttttttgtcgattttttctttacgataagctgcgttttagttgtttgtttctttgtatttgttgccattgtttccaatggtgtaaacattatcattgcagctaataatagcgtaacaattttgcctattttcattaaattccccttttaatcatagaatatttatttttctgctaatttatatggattgcttttctcttttcgttcacgatgaacataactcgacatcattaaaccaaaagctgccattaaggtaacataagaggttccgccataactaaacaacggcaatggaacgccaactacaggtaaaataccgcttaccataccgatattcacaaacacatatacaaataataagagagcggttcctcccgataaaattcgtccaaaggctgaggcagattttgccccaatcattaatccccttgcgataataaataggtaaatagctaataataccaaaacaccaattaaaccaaattcctcactgagtaccgcaaagataaagtccgtatgtggctcgggcaaaaaatctaactgagattgcgtaccttccatccaaccttttccttcaataccgccagagccaatagcaattttggattgaataatgtgataacctgttcctagcgggtctttatcgggatcaattaacgtcattacccttgtcttttgataatcgtgcatcaaataaaaccacattatcggaataaatcctgctagaaagacaataccagccccaataagtttccaacttaacccagcaagaaataaaacaaacagcccagcggcacaaactaaaatagaagtacccaaatcaggctgcattgcaactaataatgttggcgcaataataatcgccagagcaatactggtatcgcgtagatttggcggtaaggaacgattacctaaatagcttgccaccattaacggtacagaaagtttggcaatctctgagggttgaaatcgaataaatccaagatttagccaacgttgcgcgcccttactgatttcacctgccacatcaaccaaaatcagcaaaataatacaaaccacatataggcagggtgatactttttcgtaaaaacgaggggggaacatcgccatcacaaacattacccctaaacccagacacacttggattactctgttggtaaacattttttcactgccaccgcttgcactatataagactaacaaaccatagccagtaattgccagcaagccgattaatagccataaatctaaggcaaagatcttccaaaatcgtcctaaaaatgatgatttattcactcaattcctctgcttctgggggttcacgttcttctacaggcaacggtgctgtagcttcggtttggtgtaacaaagcataatccataatctgtcttgctatcggtgctgcggtactaccgccaccgcccgcattttctaaaataatggaaaccacaattttagggttatcatagggagcatacccaataaaccaaccgtgatcgtgtaaattcttttttaaacctttggcatcataactttgtccgtttaaactaaagacctgagctgttcctgttttacctgcagctcgatacgcagtaccagcaaaggcttttcgcccagtaccgttgctcgcattaattacgttatacatacccagttttgagatctgccaataaaggcttggcacatcagaaatatcctcgtataacaacggatctttataaggaataagctcactcgacattatctctttcatcaagtgaggcgtattcacccgcccattgttaatcagcactgccgttgcttttgccagctgtaacggtgttgaaatccaataaccttgcccaatgccgacggaaatagtatccccttgtaaccaagattttctataacgtttctgtttccactcacgacttggcataattccgacggactcttcagccaaatcaatccccgttttcacaccaaagccgaatttcttcatccaatccgacatcttatcaatccccatatcataggcgagttgatagaaaaacgtatcagacgactcgacaatcgccctattcacatcagttctaccgtgccccccttttttccagtcacggaaacgctgtgtagaaccaggtaaaatccaaaaaccagggtcataaattgtcgtgtttggagtaatcttaccttccgttaaacctgctactgccataaacggcttaatggttgaagcgggtggataagtcccttgtgttgcacggctatacaatgggcggtcaggatcttctaacaactgcttataatctttacccgacaccccatcaacaaacagattattgtcataacttgggtttgtcaccatcgccaaaatactgctgtctgtcggatccaacacaactacagcccctttttgattatccaataaatttgccacatagcgttgcaaatcaatatcaatgctcaaacgaatactgcttccagccactgcaggctgatcacgcaatttacgaataactttaccacggttattaatttccacttcctcaaaacctgttacaccgtgtaactgctcttcataaaatttctcaatacccagtttcccaatatcgtgcgaacccgcataatttccgaacttaccttcctcttgtaaacgtttcttatcccgatcattaatcttcgcaacataaccgaggatatgggtcaaaatatccccataaggataatttcgcttaaaataagggtgaacgtccatacttggaaaacgatattgattaaccgcaaaacgagccatctgctcttcggttaaatcaggctttaataaaatcggagtataacgagttgtccgttttttctctttatgaaagttctcaatatcttgatcggttaaaccaaccaataattttaattcttcaagggtctgatctaggttatcaatcttctctggcacaatatacaaaccaaaataggttaagttttcagctaaaaccttaccgtttcggtcataaatcagcccccttgtcggaggcacaggcaataacttaatccgatttccatcagaacgagtttgataagaggcataatcaacaatttgcaaatgataaagatttgtcagcaaaatacctgttaaggcaatcacccccacaaacgcaatcaaggcgcgacgtacaaacagatttaactctgcttgcccgttacgcaccttgtcataattttgcggttttgcgaatttaccaaacatttgccattattctcgatgataagggtgatttgttgtcaaagaccacgcacgatataaactctcagccaccaccacacgcactaatgggtgaggcaaggttaatggcgacagcgaccaactctgctctgccgccgctttacattcaggtgaaagcccctctggaccaccaatcaatagacacacatcacgcccatcattcttccagctctctaactgctgggcgagttgctctgtcgtccaaggcttaccaggaatatcaagggtcacaaccttcgcacgcccacaagctgccaacatcgccttgccttcttgctctagaatgcgtttaatatccgcattcttaccacgcttacctgcagggatctcaatcagctcaaaaggcatatcttttggaaaacgacgctgatattcctcaaaacctttggtaacccaatcaggcattttagttcccactgccactaattgaattttcatctacacccaaagtttttctaattgatacatctcacgactatcttgttgcaaaatatgcacaatcgcctgcccaaaatcgaccacgatccagtcagcaactgctttaccctcgtgagcaaacacgtccacaccagctttcttactttccacaatcaaattatctgcagtagaagcaacgtgacgacttgatgtccccgtacacacaatcatcgtttcagtaatgctcgatttccctcttacatcaatcgcttgaatatcctgagctttcagcccttcgagggtttctgttaaaaattgaactaaatttatggtcatatcttctattcagtctatcaaaaattggtggattatagcatataaaaggacgcgatcaggaaaaagtaatatgtttacaaaggtttcataagtatcatctctcttatatgatgatttaactatttacctgtaatagcaagtatctacttatcagtatttaagaaagtcataatataaatgcccacactatatcattaacacttaatagaaaaatcctattacagatgcatgaattttaaacgtacaacaaccattattaatatttttatttgacagttaaattaaattaattagaatagggtaaaaaagcattatgacacaaatgacttactctatgcgggaatagctcagttggtagagcacgaccttgccaaggtcggggtcgcgagttcgagcctcgtttcccgctccattattgtgcccgagtggcggaatcggtagacgcaagggatttaaaatccctcgcctttcggggcgtgccagttcaagtctggccttgggtaccatgttaaatctctttgagaaattctgttaaaaaatcacttaattaataccctgaagtttgaaaattacccctagttatttccgaagaggttttaatgctctttccgacactctcgtctggcatactaattcaacgctataaacgtttcttagctgatgtaaaacttccaaacggagaacaaatcacaattcactgtcccaatactggagctatgactggttgtgctaatcctggagacattgtttggttttcaacatcaaataacctcaaacgtaagtatgcctatacttgggagctcactcaaactcagtcaggtgattttatttgtgtaaatacacatagagcaaaccaacttgtttctgaagcattaaaaaataaatggatccgtgaactcgtagattacgatgaaatcttacccgaacagaagtatggtcaagaaaatagtcgcattgatttcctcttaaaacaacaaaatttgttggactgttttgtagaagtaaaagcaactacgctactcactgaaaacggtattggaatgttccctgatacaaaaactgaaagaggacaaaaacatctaagagaattgatagcaatttcccagcaagggcaacaggcagtcattttttttgctattttacatacaggtattaaggcctttgagatagctaagaaaattgatgcaaaatacgctcaaatttttaaggaagggatggataatggggtaaaaatgttggtatataaaactgaaatgcttttctctggaaaaacaccaacaggaatagaattaattacccctttaatttagacactctaaatatttttttaaaatagcattaatcgcattcgcatagctttcagattttgtgccaaaaataacgtgtacgttattttcaacaatttgtaccacttctgcggcaccaaatgcttttaagcctttacggtcaattttatcttttgattttagttgaactcttaatcgagttaaacagaaatcaagatattctatattttctgcaccacctaatgcagtgataattttaggggcgatttcatcggcagaaagagaaagttctaccgtttctttttctgagttaaacaggttttttaataaatttgaacatagcgaactcctataaagtgaaatatgaacagcgtatattttagacctaattatgataaattctattcattttacaaaaatattggttaatattaccgcttacacttgaaactgatgatattgcccttaaatatgcacgcagttttttagaaaaataggaatttcaatgacaacgatcgtatgtgttcgcaaagatggcaaagtcgctatcggcggtgacggacaagcaactttaggcaattgcgtagaaaaaggtacggtgcgtaaagttcgccgtttatataaagataaagtggtaacaggctttgcaggctcaacggcagatgcctttattttgcgtgatctgtttgagaaaaaacttgaattacatcaagggaatttagtcaaatctgcggttgaactcgccaaagagtggcgtaccgagcgctcacttcgcaaattagaagcgatgatgatcgtcgcaaacgaaagtgagtttttgctggtttcaggtagtggtgatgtaattgagcctgaatttgatgtattagccatcggctcaggtggtaactatgcaaaagctgctgctcttgccctattaagaacggaaaataatctttctgctaaagaaatcgtggcagaagcgttaaaaattgctggggatattgatatttacagcaaccataatcacgtgattgaagaagtatagtagagacacactgcgtgtgtccaaaaataaatatattgatgtgaattaacggacacacgcagtgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgctaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtatgcgtaaactgctaaccattatgaatgcgttggttagacgcaatgaaaaatgggacgctacacgctacttatccacagaatctgtgggtcaaaattgaataacttttttgtgtgtaaacacagttgctacaaaatggaataaaactatgtcaatgacccctcgtgaaattgtgtctgaattagacgcacatattatcggacaaaatgaagctaaacgagcagtagctattgccttgcgtaaccgctggcgccgtatgcagttgccagaagaactgcgtcaagaagtgaccccgaaaaatattctgatgatcggtccaacaggcgtgggtaaaaccgagatcgctcgccgtttggcaaaacttgccgatgcaccgtttattaaagttgaagccacgaaatttaccgaagtcggctatgtgggtaaagaggtggactcgattattcgtgatcttgctaatgtttcaatgaaattggttcgccaacaagcggtcgaaaaaaaccgtatgcgtgcgcaagatgcagcggaagatcgcattttagatgtgttattaccgccagcgaaagatcagtggggaaacgtgcaagagagcgataacacttctactcgccaaatcttccgcaaaaaattgcgtgaaggtcagcttgacgataaagagattgaaattgatgtcgcagcccaagtgagcgttgaaatcatgactccaccgggtatggaagagatgacttctcaactgcaatctctctttgagggaatgtcgccaaacaaaacgaaaaaacgcaaaatgaaaattaaagatgcgttaaaagtgatggtggacgaagaagcggcgaagctggttaatcctgaagagttgaaacagcaagcgattgaagcggttgaacaacacggtatcgtctttattgatgagattgataaaatctgtaaaaaaggcgaacacagtggcggtgatgtttctcgtgaaggtgtgcaacgtgatttactgccgattatcgaaggttcgacagtcaatactaaacacggtatggtcaaaaccgatcacattctctttatctgttctggtgccttccaagtggctcgtccgtctgatttactgccagaattacaaggtcgtttaccaattcgtgtagagcttaaatcacttaataaagaagatttcgagcgtattttaaccgagccgaatgcgtctttaaccttacaataccgtgagttaatgaaaaccgaaggcgtggatattgagtttaccaaagatggtatcagccgtatcgccgaatccgcattccgagtgaacgaaaaaactgaaaacatcggtgcaagacgtttgcacaccgtgttagaacgcctaatggacagtatttcattcgatgccagcgaacgttcaggcgagaaaatcgtaattgacgagaagtatgtgtctgatgcgttgaatgatgtggttgagaatgaagatttaagtcggtttattctttaactatatacttacagtacaaatggaaattaaaattacaaaaatatgcattacaagcggtgaaactctctcaattttttacaaaattttgctacaatctatccactcacattccatttgcaaagagatgaataatgacaaacatcagcacttttaaccgttcttggtcacgagttattttaaatgctttactccgctacggcgtaaaacatatttgtattgccccaggttcacgctcaacgcctttaacccttgaagcattacatctgcaaaaacaaggtcaagctgaatgccatagccattttgatgagcgtggtttaggcttttttgcactaggacttgcaaaagcaacgcaagatcccgttgcaattattgtaacttctggaactgcggtctctaatctttaccctgcggtgatcgaggcgagtatcacacaccataaacttatcgtgctttccgcagatcgcccccttgagctgatcggctgtggggccaatcaagcgattgaacagcaacatatttttagtcattatcctattgcaaatctcaatttaccaaaaccaagttcgcaatatagtgcaagctggttagttggtcgtgtagagcaagcctgttctaaacaagctcaaaaaggtggtgttatccatatcaatgcgccattcgcagaaccgctttatgaagctgacgaggagagcattgggcaagatccgtggttgctcgcaattcaaggttggttgaataaacctcaggtgaaatggtacgatcaacaagcgacccaacaagatgtgttgatgcacgaaaattgggattattggagaaccaaacgtggtgtgattgtggtcggtaagttaccgcttgagcagggaatgggattaaaactgtgggctgaaacgcttggctggtgtttgatcagtgatgtgcaatctggggttgatgcctctctgccttatgcagatatttggctgtcaaacaaaacagtagagcaacgtttattacaggcagacattgttattcagtttggctcacagattgtgagcaagcgagttaatcaatttttatcggcttttaaaggcgaattctggctggttgaggaaacgacagattatcttaacacctatgctcatcaacaaacgcgttttgtggcaaaagctcaccactttacccgtgttcacccgccacttcgtcaaaaaccgtggctgttggaacctttggctctttctcaattctgtgaaacctttattgaacagcaagtgggtggcaatctcaatgaagcctctctagcacatcatatcgaacgtgtattgccagctaatggtaatttatttattggaaatagtttatttgtccgcttagttgatgctttgtgtaaattgccagaaggttatccgatctataccaatcgaggtgcaagcggtattgatggattaattgcaacccttgcaggtattgcaaaaggtagcggacagccgacagttgcagtgattggggatatttccgccttgcacgatttgaactccgtatcactcttacgccagattagccagccgaccattttatttgtcattaacaataatggcggtgcaatttttgatatgcttccggtcgatcaaaaagcgaaagataaattctatcgtcttagtcataatcttgagttttcacagattgcgacaatgttcggtttagagtatctacgtccttatacttgggcggatttgggaacaaaacttaaacaagcctatgctcgtcgaggtgttactattgtggaaatcaaggtgaatgatcaggaaggtagtagcctttataaatccttgattgaacagatctctcgtgcttctatcgactaatgttagcaacaacttggcacagtcattcaggaacacccgtggtctttctccacgggtttcttggttctcaacaagattggcaacccgtcctctcgctattgcaaaatgagattgcaatccgaccgcttacccttgatcttgctggtcatggtcacagccaagctatctcgtgccatagttttcagcaagccagagaacagcttcaccacatcttgcaacaacatcttgctgaacagcccttctatcttgtcggctattcattaggcggtagattagctttagattacgccctcacaacccaaaatccttatcttaaagggatcctactcgaaggggcaaatatcggcttaagcagtgatgaagaaaaaaaagcacgttggcaaaatgattgccactgggcagatcgcctaagcaatgaaccgcttgcaaatgttttagaagattggtatcgacagcctgtctttgccaatttaagcgaaagcaagcggacagatttcatcaaaaaaaggctaaataatcacgggcaagcactagctcaaatgctcaaagccactagccttgcaaaacaatcctatttttccccagagcaatgtcatcagtttcacgggaaaatgctatttattatgggagagcgggatagtaagtttcatcaaatggcagaacaacatcagctcccctatcatcaaattgcaaatgcaggacataacacccattatgaaaatccaggtgcatttgtaaaacaccttattcagtttatatcaaagtaggaattacaatggctttacatcgttgccccgaatgccttaaaaaaatcagtgaaagtgccgttacttgcccacattgtggcttttcgttcaatgaagctgatttggaaatttataaacaaaagctagaacagcgtcgtttgcataatcaagagataaaccgcaaaagcgtcaaacttcacttgatttggttaggtatttttgtgttggttattgggctggcgagtttattatctgtataaatgaatgatgatgtaagtataaaaaaggatagtagataaaactgttgtcccaagaataggcatagtagacaaaatgagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaattaccgtcgaggccgcgttaaatgatgaactgaccgaccatcttggttatctaaaacgaagattcagctttgcattgtgcatttagtgcgtaacagcttgaaattcgtttcgtggaaagattacaaagccgtcaccgcagatttaaagcaggtttatcaggcctcgacggaagcacaggctcgcgaaaatctgaccgcactttcgcaaaaatggcaggcaaaatacccgcttgtggcgaaaggctgggaagataactgggcaaatattgccacattttttgattatctggctgacattcgtaaagcgatttataccacgaatgccgtggaatcgcttaatagcgtgattcgtcgcgtgattaaaaaacgaaatgtattcccgacggatgattccgttttcaaagtgatttggcttgcgattaaagatgcaccaaaaaaatggacaatgccgattcagaaccggaaaccggcgatgaatcgattgatgattgattttggtgatcgcctagacgatcaccgttaagttgaaatgggtgtttacacagaatttgggatagggtcggatagggtcttcgccaaacgttctttttccgcctgttcagccgctaaacgctcggcttcttcttttgctaaacgctctttttcagcttgttctgctgctaagcgttcagcttcttcttttgctaaacgttctttttccgctttttcagcggctaatttatcagcttgagcctgttgttctgctgtttgtgaggtattctggtttacggtgctatctgatgagccgccaccactacttccacaagccgttaagcccaaaagaatcaaacttgctaaggttactttttttaatgacataagagtttctccttgaaataaaatgctgaaaatatccttgtaattatcctttttctaaacaattatttatcaattaaattatttaaagcgtaaatcgttttattgataaaaaagatttatagctattcataatgcagaaatgcactcagaatccgataaaacaggctttagcaaaagattaaaagtcgccttagaattggctgggcttcaatctttatctttagctgaaatttcaaacaaatttaatcttcgtcacccgaacaagcctgttacaccacaagcggtacataattggctgattgggcagtctattcctacgcctgataaagtcgaaactttgtctaaatggctaaatatcagccctgaatggctacgttatggaaaagagcattttgaaggggagagcctttctcaaaatgaaattttaatgttgaaatattttcgtaatttacctgctaaccgccagcaagcgattttggcattactacacgaatttcataaatagataaaatgactggcgttaattcaacgaaaacagcataattccatcgtttatttagtgagattaatctatggaactcaaacttccccctcccttagttgcactaatttgtgcaacaatgatctattttctgccgaactatgcagagccgaattgggtctatcaaagttttgcgataatctgttttatatttggggttagcgtcgatctctgtgcattgtgggcttttcggcaaaataagacgacaatcaatccgcttgctcccaataaaacatcagctttaacaacacaaggtatttatcgctttagtcgaaatccgatgtatttagggttggcaagtctattatccgcttgggcattttggctaggcaatgcgttcgcattgcttgtcgtgtggggatttattgcttatataacccgttttcaaatcgagccggaagaacggattttagaacagaaatttggagagagttatcgccaatataaacaaaatgttgctcgttggttgtaataaataaaggggctgtattagattagccctaaattccacaccattttctcaaccttttaagttgctctttgggtgttccaaagttaaatcgaaattcacattctttaaagaataaagggaaactttttcgatcaatcccattatattttcggaggaatagtagacaaaatggttgctatgccatataaaaagcagtgttatgtagcaagtgctatataataccgattaaacgcatagtttgtaaaacattaacacatttgtctactatgtgatttacttcggtaatctctgacactttggacaatagaaactatttcgttgcccgattaccttagcttcaataatagagccacaatcgttacattcctcgcctttgcgaccatagacttgtaatacttgggcgaaatatccaggttttccgtcaggctgaataaaatctttcaaggtcgttcccccttggataatcgcttttgtcaaaacctctttaatcacagtgactaatctctcacactgtttcgcggttagattttgtgcggctaattcggggtggattccagccataaaaagtgattcgcaagcatagatgttgcccacaccaacaacgatagcgttattcataatgaagtttttcacagcaaccgttttattgcgacttttttcaaataaataaccgcttgtaaaggcttctgaaagaggctctggccctaaatttgctaataactctgctgtttcagcttgctctgcccaaagccaggttccaaattttcgtgggtcgttataacgtaagattacgccgttttctgtgatgagatcgatatgatcgtgcttatctatcgccttattctctttgaccgataaaatacccaacgatcccgacattcctaaatgaactaaaatatcgcccttatctgtctgaataattaaatacttagctcggcggtaaatctcaattatcgtcgccccttgcatagttgaaagctctgaactcacagcccaacgtaatttcggctgacgaacaataatctctttgatcttctgccctacaaggtaaggcgagatgcctctcatacttgtttcgacttcgggtaattctggcattgtttttccttataaaaaaggggcgaaaacgcccctatacaacaaaataagatgaattaatcttttttcactttaccaaccacataaccaatcacacagccaacaagtgcaaatggcaaccactccattgagtaggctttaagtggaagttgcgcaataaattcaacgcctgccacagataagattgaaatgaccgttacaaatacaatcgataaaccttgtgctaaacgtggtaatgggaagaataagttcactaataataccaacaatgcagtcattgaaatcgggtataacacgagtaatacaggtacagacttgctaattaccgtatttaaaccttggtttgctaaaccgaagccgattaacgtgaaaatcaccgcataaacttggtatgaaattttcgggaaaatgctattgaagtaagctgatgttgctacaatcaaaccaatcgctgtggttaaacacgcaagagttacgatgaaacctaatacggtacgacctaattcaccaaaggcttgggttgtggtttcatttaaaataaatacccctaagttttgccctttagcagcaacgtctgccactgtttctgcacttaatggaattttataaccgatccagccgatagaaatatagataacggctaatgaaattgcagcgacaaaagaagcgtaagtcgtttgtttaactaaagatacgttgctatttgcattttttgctttaataccattgatcactaacacagagaaagcaaaggctgctaatgcgtccattgtttgatagccttctaagataccgcttgttaaaggtgattctaaggttttagcttctgctgtttcgacgcctgagaatagagctatcactttgatcactaaggcaataattagaattaataatgcaggggttaaaattgtaccaatgcggtcgatcattttgcttgggtttagacttaaccaaagtgctaaaccaaaatagacagctgtgaaaataaatagcgatgtagaatcgggctgacctacaaacggcacaattgccatatcataagcggtcgctcccgtacgcggaattgcgaagaatggaccgattgtcaaatagattgccgctaagaaaagcaacgaaatcgctgggtggatattttcaagggcttttttataaccaccttcgtagcaagctgcaacgatagttgcgattaaaggtaagccaacacctgttaaggtaaagcctaaaattgcagtccagaaatctgctccgctatcgaaacccaatttcggcgggaaaattaagttacctgccccgaagaaaattgcaaacagcataaagccgatgacaaagatatttttaaccataatgtatttctctagtttatttttgaaagaggatttattatccacaataatagataaaaataaagctgaattttgcctattacaaaattcagcttttatttattttttgaaataattaattcatatataaaccgccattcacatgaatggtttcaccgttgatatatgctgcatcatcagaagctaaaaatgccaccgcttttgcaatatcttgtgctgaaccaagtttgcctgctgggatttggcttaagatcgcatttttttgatcttcggtaagttcgtctgtcatatccgttgcgataaaacctggggcaaccacgtttaccgttacgccacgagaagccacctctttagccagtgatttagagaagccaacaagacccgctttcgccgcacagtagttggtttgccctgggttacccactgaacctaccaccgaaccgatagagataatacgaccgccttttttcatcatcggacgtaataccgctttagataaacggtagattgatgttaagttggtttgaataatgtcgaaccagtcatcttctttcatacgcatcaataaaccgtcacgagtgatccctgcgttattcacgagaatatcaatgtcgccaaactgttctttgatttgagcaagcacttgctcaattgaggtaaggtcagccacgtttaacactaagcctttgcctttgtcacctaaggaagctgagattgcctctgcccctttttctgaggttgccgtgccaatcacgaatgcacctttagacactaattcttcagcgattgcacgcccaattccacgagttgctcccgtgactaatgcgattttgttttgcatgtatatttttcctaattgaatttaaccatttccccctttgaaaaagggggggctagaggggattttaaatggtacgggaaaatatccagatctttaaatcccccttaatcccccttttttcaaagggggaaatttttaattaaaacaccaccgcctcaaacgataccacatcatttaccgcttttgccgataattctttaacaatacgacctgccaagccggtcagtactttatttggaccgatttcatacagtgttgttacaccatcttgtgccattttttcgacagtctccgtccaacgcacagggctataaagttggcgaaccaacgcatcacggattttatctgcatcagtttcaaccgcaacatctacgttgttaattactggaacaagcggtgcgtttaacgaaatattttgcaatgccgccgctaatttttctgctgctggtttcattaacacacagtgtgaaggcacgctcaccgctaacggtaatgcacgttttgcgcctgcttctttacataattcgcctgcacgctctgccgctgcttttgtgcctgcaatcaccacttgacctggtgagttaaagtttaccgctgaaaccacttcgccgatttcacttgccgcttgttcacacgctttgatgatcgcttcattatctaagccgataatcgcaaacatcgccccagtaccagctggcacagcactttgcattgcttgaccacgcaattcgactaatttgattgcatcttggaaatccaacacgtcggcacaaactaacgccgaatattcgcccaagctatgtcctgccattaccgcaggtttttgctcagggaatttctcttgccaaatgcgatataaagcaacagaagctgccaataacgcaggctgggtgcgttcagttttacccaaatcttccgccgtgccgttttggactaaatcccataaatcataaccaagcacatcgcttgcttgtttgaaagtttgttctaccacagggtaaacaggtgcaagatcagcaagcataccaaccgcttgtgaaccttgtcccggaaataccattgcaaatttagacattgtttgttcctcttttaaatttgtaaaaatttgttgaaaattaaccgcttgcaaatttccccctctttgaaaaagaggggcagggggagattttttaatcgggtgaataatacaatttgccgatttcaatacgttgtcgccctgtttctaaacgccatttattcgtgtcacgcaatgaataaacgcaaccgcaatactcttgttggtaaaaacgttcacgtttgctgatttcgatcatacgttgtgaaccgccacctttacgccagttgtaatcccaataaaccacatcatcataagccgctgccgcacggtgtccgcaaccgttgatttggttcatatctttccaacgagaaatccctaaacagctggtaaaaacaggatagccgttttcgtgggcatatttggcggttttctcaaaacgcatatcaaagcacattgtgcaacgaatgccacgctctggctcccactccataccttctgctttcttgaaccactctttacggtcgttttcataatcgtcatcgacatcaataaacggaatgccgtgtttttctgcaaagcgaatattctcttctttacgaagcaagtattctttgagtgggtgaatgtttggattgtagaagtagatcgcaaattcgatccctgaagcgtgaatagcttccattacttcacctgaacaaggcacacagcaagagtgtagtaaaagtttgttgtgtccgtttggcagttctaatttttcacgcacaaaaggggtattcggatctttgcctttacgggttaatttgcgtttttgttgtaacgcttctttgtgttcttgaggttggtgttctgtcatttatattttcttatcacaatatataaccccttctgaaccgcctgagcgtgtttaaatttgtaggaacatttttctctgagccaacgaagttggcgaatttaaaatgttccgttaagcaaatttaaactaagcgaagataagcggtgaagtagggtcgcctttcttttggttacttttctttggcgaagcaaagaaaagtaacatttacttaataactacgatccaccgacaaatacgccaatgaaatcaacgcttgtttatattcgctttccggcaaaatagcaattgcatcaacggctttctgagcttcctgtttggcacgttccattgtgtaatctaaggatttatgctccgccataatcgctaaaatctcgtctagggcttcacgttttccgccctgttcaatcgcttcacggattaatgctgcttgttgcagattaccgcttcgcattgcgtgtagcaatggcaaggttggtttaccttcggctaaatcatcgccgatatttttgcctaattgttcagcattcgcactgtaatctaaaatatcatcaaccagttggaacgccgtaccaagatagcgaccataatcacgcattgcaatcacagtcgcttgatccgcacctgatacaatcgcagagcattgacttgccgcttcaaacaggcgagcggttttactgtaaattacctgcatataattctcttcggtggtttcaggatcattgacattcatcaactgctgaacttcaccttcggcaatcacgtttgttgcatcagacatcacttgtaacacatcaagagaacgcaaactcgccatcatttggaacgcacgggtataaataaaatcacccacaagcacacttgccgcattaccaaaacgggcatttgccgtttcacgtccacgacgcatatccgactcatcaaccacatcatcgtgtagtaaggttgctgtatgaataaactcaacaaaagctgcacaagtaatatgctcttgacctttatagccaaccgtatttgcagccaataccgcaatcaatggacgaatacgcttgccaccaccgctaataatgtaatgccctagttgattaatcagaacaacatctgaattgagctgagcaagaatagcctgatcgactgcctgcatatccgctttaacgagagttaaaatttgctctaaggaaagttgcgttgtcattatcgttatcttttcgttacaaaataagtcaagattttacctcaatggctccgttgtatcaaaaaaagaatgcaaaaaagcggtctgttccgatcagaaaagtgcaaggtttatgtgaacaaatagacataattaatgcttaaactcaacataagtataaataatcatctctgactatctttagagtaaaatcatttagtcgctataacatatgattttgataccattgcgctaataaaatccctgcatttacagccacattcagcccactattgagagaattagcaaatgagagctgaacaatactatcttcaggatattcaacttcatttgatataacttcacttaaaacaaatacaatctttttagataatactattctagataaatgtggtgcttgcctttggcgagttaaatgcacaatttgataaccagccttacgtaactgtattaaggcaatgtgtttatgttttgtctctaagggatacacaaattctagaccaccttcagcaacacgagcagcattacttgaattcagtatgtcattattttctacaataatgccttttattccataaaaggcacaagtacgtataattccccctatattttgagcattatttacaccatctaatagtattaagcaatcatgttgtcgttccagttgtaaatagccttctaacgagaatggtgtagatttttttactaataaacacataccaccgtgatgctctgttcctgtaactctcagcatttcttcagtatctactaaatgatatgcctttttatgatctgcaagatagcttaataacgctcctgttttttgggcacactcagaggtaatccataaacgaacgatagcttcagggcgttgttgaaaaatagcagaacaagcatgttctccataaactttcatttcactggctcgattattacggattttttctggtgctcttggagatagggcaccacttttactttttataggtttatttctgtcttttacactgacttttacaaagccctctttactagatttgttagcttcagttgtataaatcgataaacttggtttgtctttgtagtgctcattttttgatgtttgaacataatcttgttgtagtgaagattttttcgttttaaatttaagaggttggcatgcttttactgacttaaaactaggggggttaggattgaatttattgttcatcattttcttaataaaaattacatttgataggtgattaatgaatattaaacggaaatataaaaagtgtcggtaatagaaaaactaaaaccaacactttttactatctatctggctttaacattttaatcaactagcaatcttgtttaccatactgctcttgacgaagaattgcacgcacgcttgcatcaaactgtgctaatacttcttctgcatttttcggatcagttccacgagcatctaagtagaacttgattttcggttctgtacctgatggacgagcgattaagcgactgccgttttcaagcacaaagactaaaatatcgctttggcgatctgttttcgtatgatctaagaaagtcgctactttgaaaccacccacttcgcttggtggattggtgcgtaatgcagtcattaacttaccgattgctgataaatcatcaacacggatagagatctgaccgcttacataagccccaaactctctagtaaagtcatctgcataatctgctaaggttttgccctcttttttcaagctacgcacaagatctaagaacataattgctgcagagataccatctttatcacgcactttatctggatcaactaagtagcctaatgcttcttcaaagccgaataataagccgtttactttaccgatatatttgaagcccgttaatgtttcttctgactcaaagccatatttattcgcaatttctgcaagtgctggggaagaaacaagtgagcacgctagaacaccttttttgccttgtgcgtgatattgttttgctaaataccaacctaagaaacaaccgataacattgccatgtaaaggtttccagttaccttgtgcatctggtactgccactgccaaacggtctgcatctgggtcgttcgcaataataaattccgcatttctctctttagctactttaatcgctaaatctaatgcacctttctcttccgggttcgggaagttcaccgttgggaatgtaccgtctggccatacttgttcagcaacgatagatggttgcggtaaacctgctttggctaatgttttgcttaatacttcataacctacgccgtgcattgcggtataaacatagttaatatcaacttgtggctctttagcaaggcttgctgtttttgcaatataggcatcaacaatttcatcatctaatacggtgtaattttgactgcgtggtaagtctttgatgctgccttgtgctactttatcaatacaagctgcaatttcttggtctgctggcgatacgatttgaccaccgccgtttgctttacctaaataaactttatagccattatcttcaggtgggttatggcttgctgtgaccattacacctgctgtggtatcaaagtacttgattgcataggcaagcactggggtcggtaattttcttggaagaagataagttttaatgcctgctgctgccataatttctgcagtatcacgtgcaaacacatctgaatttttacgtccatcataacctaacacgatagatggctctttgtcatagccttttagaaattctgctaaaccacccgcagtttgagcaacaagtacacggttcatacccattgaacctgcttgtaagcgaccgcgtaagcctgcagtaccaaattgtaaacgtccatcaaaacggctagataattcagcttgagctttcgcatcatttgcttttgcttgcgaaatcaattgctctaactctgcacgagtttctaaatcaggatcttgatctaaccaattttgagctacttgaaagagagtttccatagtgagtttccttatagttaagataaacaaatagacagtaataaactaactgaaaagcagtaagattgaaatgattatttgtaaatattgcgtagttatttgatatggataaaagacaaacggttacatataaaaacaccgcctaattagacggtgtatttatcattaaattagaatgtttgagcaatacgatccagttcaactttagccgcttcaagagctttatctgaaatttctgctccatagccaagaccttccgcgtaaacaaactcgatgtcaaaaataccaataaaattaagaactgcatgcatatacattttggctaaatctgtaggcgtatccctatagactcctccgtgagtaagcacaacaatagcttttttacctttaattaaaccttcatgaccattttctgtataacggaaagttacgcccatacgggttaaatagtctagatatgtcttaagctgtgctggtatacctaaattatacataggaacagcaaatacaatgagatcgcattgatttacttcattgatcagattattagaaagagtcagagcattatattgagtatcatcttgtgattttcctcgtatatctaatacagcatttatatcataatacgggagcggattttcacctaagttgtgttctataatattagctgaaatttgagacttgaagtgatcaaccaattgattagattttgatttatccgcaagaatacttgactttatcactaaaatatttttcattgcaactccgaaggtcaaacgattatacctaataaacgacgattattttatctaaatagctagagaaataaaataaaaaacgtctatgaaaagaattaaagtgaacttttttttgacagcttactatttaacttgtccaacaccatttcaggctgaatatcgatcaaactttggtgataaccgtcttgcccttcgcctttgcggatcttaattaaaccaccttcaatcaagcggataatcgccgcagatttagagagcggtggcgtatattgcgggctagttggaccatagagcgcaacaagcggtcggttaagagcagcggcaatgtgcattaatccagagtcgttgctgacaatggctttgcaatcagcaattaaatcaacagcttggtttaaatccgtttgtcctgcaaggttgatacagtagcgttgtaaggcttcaggcaaactattgcgaatttgttccccggcttcttcatctttttttgaaccaaataaacgcacggaatagccttgctcaatcagtttttgagccagtgttgcgtagtggtaatgaggataacgtttcgcaggcccaaactctgcacccgggcagaagccaatcgcttcgcggttttcggcatattcaaactgtttagcaaaatgttgtttggtttgtgcaattttctcgctatcgacttgtaggtaaggataagcaatcggtaagttttctgctgtcgggattttaccttgctcaaacgcaagtgccacataactttgtaccatcatcggatagtcgtttttattcgcgcgtaaatcgttaagaaaaccgtaacgcatttcccctttccagccacggcgttggggaattttagcaaacagcggaataaaagcagatttcaatgaattaggcagaacgattgccatatcgtattgatttcgcaaatttttgcctaaattgtaccgcttacataacgcaaacgagccgtgaccgattggcattgaaatcgctttgcgaacttctggcatacgagaaagtaatgggcgacaccagtcgggtgccatcacgtcaatttggcaattcggatagttggttttgagctgttgataaagggcgtgggacatcatcatatccccaacccaagaaggtgcaataactaaaatattcattatgcttcctattgcttcacgcagttttcggcaaggattttattgcggttatctcgcaatgtgcctttgccatcaaaatcttctgaccatatccagcggatatcgctgtattttttgccttttttcgtcacacttgaataaagcgtatgggtactttgctgaaaagtaatatcaacagctctatttttctttgtgttgtcatattgtaccctaacgatttgtttattatcacatagatattcgtaataaatacgttcattaattttaacaatcatttgggtattttttgttggtattaatgacttttcaagttgagaaacaggtgatacagcaggtaccgtacaagcagagagcaatgctatcattgcatatattgaagaatacttcctcactattatggatatcatctcatatctccttttaaatatagagagaggcaatgatgatattattgcctcaatatttattatttaaaaatataagtaccatttgattgacgagtataaattccagcatttattctcatttcaacaacacggctatttttgtctaatcgaacagttactttttctccgactttgagattgctgaccgctttgtttgctttgctcatagcgtttacatctgaaatatttaggtgattgtcacggaaaacctgcattaaagacacaccttttggaatcgttaatgtcttgcttgaaataaagccagatgaagctgatgtaacaacaggtttagcagttacgactaccacttttgttttagcaggctgttctttttctatgttgacttctgctttttgagttacagcagaaactggtttaattttttctacttgagttttctcagcttgaattttctctacttctgatttttcttcttccatctgatagctcacacttgcgctacttgttggttttgttacgacttcctcagtaggctttgtaatttctgtacttgttacagaaataggcgtaatagaagcattttcaacgttagatgaaactgtcgaacctcccgttgttaatggcagtattatttctacggtgtttacggggggagatatcggggaagcttgctctacttgagcttgtggggcagttaatgcttttgcttcttctgctcgcttcgcttctgcttcatcaactgggcggaattcaataggtagagtattatcttgttccaattgttccagtgtttccggtgtatttggttttaacaagaaaagaatcaaaagtgatgccaataccaatgtccccacaagaagtaatcggcgagattgaaatggtaccttttctgcgattgatttttgaaaattaggttgagaactaggcagaattctctctatagtttgagtagtcattgctggttgctcggcatttgttgtttctgtttccttttgggatgcttcagataatggcccctctgttgtggtgacaacaggagaaaacataaatgcagatgttttttgttgctccaatgtacgctcttttgaatcttgttgatttctttgttcttccattgaggcaaaagaaaaagtaccacctacaggacgcttcattactggagtaaaagtgtgtcctggcgatttagttgaatgtaatgaaaaattaaccttcttagtaagtttatgtgctgaaagagttaatttgctttccgaattttcgttctctgtttttactgcgctaggctcaccaaaaacaggttctttacgtaaattttgttggctcattttgagtatcccaaatgattaagtttaaggaaacattgtattattctaaaggatttctgatggattttcagaaaaatttcacaataagcttgctatttttgctaactttttactaaaacaaaaaaatagcagtattgtctagaagatttttcaattttttcgatctgcgtcgaaaaacacatttttactcattgcaggctgtttgtttgatttgtaaggtatgcgtgcaatttaaaccaacctttaaggagtaatttatgaaaaaactttctcgttacacattcagtcttttatttgggcttttctctgcaacaacatttgctgaagaaaaagtaactacgtcaacagaacctacaccagtagtgatgcaacaagtcgcagcgacacaaaaagtaaatgcgaatgttgtaaatatcaatactgcgacagcctcagaaatccaagataagttagtaggtattggagcgaaaaaggctcaggcaattgtggaatatcgtgagaaaaacggtaagtttttaaatgttgagcagctcaccgaagtttcaggtatcgggaaagcgacacttgaaaaaaaccgagatcgtattgtgattgaataatcatatgaggggcgaatctttattcgccctgacatacggcctatttagagatagtcaaattcaaacatctaggggctgttgatcttttgagtttaaatcttaaccaaacaacaatttcccccagcgaatacaacaaatcattgctagcgatgccgcataatttcttgctaacttatcgtaccgagtcgcaatggctcggtattgttttaaaaaagcaaacgcattttcaactaaatggcgataacgatataaacaccagtctatatcctcattacccacctttgaatttcgtctacgaggtataaccggaactgcttttgttgttgtcaaaataagtgctcgtaaggcttcacaatcataacctctgtctgcaacaatggtctcactgtcaggtaacaattccacaagctcaggtgcagctttactgtcgtgaacttcacccccgtcagaacaaaatcaataggatttccacaactatctaccgctaaatgaatttttgtgctattacccgccacacttttgccaatcgcttgcggattttgaccgcttagtttgtatggaatggttaggttttggcgaactaaattataccaaatttctatgtcgtttgttttttgtgcttaaaagatcaacacgctctacttactctgctataatgtcccacttttattacaagcggtacaatttaatggaaaatttgcaagaacaacctgactggaaaccatcagcctctattcaacacttattgaaacgagcaaaaattatggcggagatccgtcaattttttacggaacgtggggtattggaagttgaaacgcctgcgatgagtgagttttccgtgacggatgtacatctttcaacctttagtactcaattcttatcgccgttttcaagccaagcgaaaaccttacacttgattactagccctgaataccatatgaaacgcttgcttgcctgcggtagtggagcaatttttcagctctgccgagtgtttcgcaatgaagaagtcagtaaacgccataaccctgaatttacgatgttggaatggtatcgtccccattttgatatgtaccgtttgattaatgaagtggacgatctgttacaacagattttagactgtgaacctgcggaatcctttagttatcaatttgtatttcaaacctacgttggcttagatccactctctgccactaaagctcagctggtggctaaagcgcgtgaacacggcttgcaatgtgatgaagatgaacagcgtgatactttactgcaatttttatttagcgaagtggtcgaagcgaatattggcaaagagcgtccaacggctgtttatcacttccctgcaactcaagcggcacttgctcaaatcagtacggaagatcaccgtgtggctgaacgctttgagttttattacaaagggttagaacttgctaacggcttccatgaactcagtgatgctaaagagcaaattcgccgttttgaacaagataatgtgttgcgtgaagcgatgggtttaccgccacagcaattagaccgtcgtttccttgaggcgttaaaagcaggtatgccaaactgctcgggcgtcgccttgggggtggatcgtttaatgatgattgcgatgaatgctgacagtatcgatcaagtgatggcatttggggtggaaagggcgtaaaattgattttgtacgtctaactgatgtacaatttcaaacaagggggatttttatgacaacaatggcaacgagccgtctagctgctcgagtaaaaccagatacttacgccttaattaaacgtgctgcagaaattgaagggataacgctcaccgattttatgatcacgaatttacaagctgccgctcgtaaggttattgctgattcagaaattattcatttatcacttgaagatcaacatcgtttggcagacgcattacttgaaccacatcaacctaacgaaaatatgctaaaggcaatgcaagattaccaagccatctttggtaaaaaatagatggatattgcgaagctctcttttattcgattttcggatttgaccattccaagaaatacctttagctcttcttctgaagagctaaatagctatttttatacgcaagtttctcaagacatcaaaagacgagtaacaaattgctttgtgttaattgatcctgaaaatcaaactatcgtaggttactatactctcgctgcttctagcatttcactaaaagatcttccgattgagaaacagaaaaaactcccccgttatcctagcgttcctgtcgttcggcttggtcgtttagcattagataaacgctatattggaaaagggctgggaagatttttgttagttgatgcgatattacgagtagtcaatgccgatattgccgcttatgcgatagtcgtagatgccaaagataaaaatgccgctgctttttatcaaaaatatggatttttatcttatgcagataacgacaaacttttatattaccctttatcttattggaaataacaaaggaacaaccttgaacaatttatttattattgactcacactgtcacttagactcgctagactatgaaactcgccataaaaatgtggacgaagtgatcgacaatgccaaagcacgtggcgtgcaacagatgatctcgatttgtacgacgcttggtcgctttgaagtgatgaagcgacttacagctcatcgtagcgaagtggccctctcttgtggtgttcatccgttgaacgtggaagatgaaccgtttgactatgataaactggtggcattggtgcaagatcctagagttgttgctgtgggggaaacggggttagattatcactacacgcccgaaaccaaagctctccaacaatcgttgtttgagcaacatatcgaggtagcaaaacaagtgcagaaaccgttagtgatccatacccgttctgcccgtgaagacacaatgcagtttttagaacaagggaatgccgagcagtgtggcggtgtgttacactgctttacagaagactgggcaatggcaaagcgtgcattggatattggtttttatatttcgatttcagggattattactttccgtaatgcggaagaattgcgagatgtggtgcggaaagtaccgcttgatcgtctgttagttgaaaccgactctccgtatctcgccccgatcccttatcgtggtaaacctaatcagccagcttatgttcgagaagtctgtgaatatgtcgcaacactaaaaggcgtatctttagaagaatttgctaacattaccacgcaaaacgtgcgaaaattgtttaaaatttaatggcaatacactccgaactttcggataaggattttttatgagagcaatgtttaaatactttctgatcttagtgtcactctcactacacatcgtattagttggtggggtaaattatgcatttcctagctatgagcaaacaatggtcacaggaatggaagtgcgtcgtatggataaagatggggtaatcagcaaatcaaatccagccgatggcgaagtgcgtgacgtgtattttcttttcaccgaacaccctgataccaaagcggtaatggtttaccgtaatgaagataccagctggggattaccgctttacttcaaatttggctctgccgatattcaagcaaaagcacaagcctatgcgaacgaaaaacagatggtacaaattaagtactacggctggcgaattaattggttgaatgaatttagaaatatcgtgtcaatcacaccgcttgcggaaggtgagactgtgtcaaaaccgtgggtaagctatattttatatgctttctttgcattgactttctttttgtctgtgcagtttattcgtgggtggtttgatagcgaaaaataattagtgtagggacacactgcgtgtgtccgtcactcaaataataaaaagatattgtggacacacgcagtgtgtccctacattcaaggcattccatatcataacaacaaaaaacaatgactacctactttatcgccgatcttcatctcaacgacaatcaacccgaattgacggatctgtttttgcaatttatgacagaaaaagcaccgcttgctgaagcagtgtatatcttaggggatctgtttgatttctggattggtgacgatgagcaatcgcctttgattgatacagtgaaacacgctattcgtcagctcacggatcagggtgttccgtgctattttattcacggcaatcgtgactttctaattggtaaagattttgctaaagccacaggaatgatcttattacccgattatcaactgattgatttatatggtaaaaaaaccttaatttgtcacggtgataccctttgtattgatgatattaaatatcaacaattccgccaaaaagtccatcaaaaatggcgacaatggctatttctctgcttaccgctcaaactgcgtattcatatcgctcagaaaattcgagccaaaagccgtgcagataaacaacaaaagtcggctgaaattatggacgttaatcctgaatttaccgctcaaattgtggataactatcaagccgaatggcttattcacggacatactcacaggcaagcggtgcattttgaccaaaattttgcaaaatctgaccgcttatttactcgcatagtccttggcgactggggaaaaactgcatctattttatctgtatcacctcaaggttttgcttttaatgaggaacgttaaatgatcgatgtgattatcccgtgctataacgcagaacagacccttcaacgagcatacaaagtgtgcttaaccaagctggattaggcacattatggatcattgatgatgcttctaccgataacacctttgctcttgccaaacagtttgaagcacaagttccacataagattagagttgaacagattcctcgaaatagtggtgttgcaaaggctcgaaattggggggcgttacaaagtgatacagaggttatcgcttttcttgatgccgatgatgcttatgaaaatggggcattgcaagttgccgaagcaattttccatttccgtcctgaagcaatggtagttcgccgtgcattcctccttgcttgtggcggttttccacaatatcaactatttagggaactgggcagtgaagatggtgctttaggcattgcaacgaccaaaatcagctatgtcgcaacggcatttactgaagcgggcgtattacattactgccgtgacggtatgcacgcagaacgtttgcttgacgcagttctctttaataaacaccctgaaaatgtaacggaagagaaaatggctcaagccaatgcggtgacagacaatatttgccaacaaatcaccgcattagtccaccatcttaagcaagaacaggcaggaatatatccgcttgtgttaactcgtgaagatattgcttagattgaagttaggtcattgctctaactgccttgacaaccccaacaaggtggctgagtttagttaaaatctcggtaagatgtgttttgtctttcacactgaccaataatttcacttgatacacgccaccttctcgctgttggctgtgaatatcaaggatattgctgttcattttggcaatcgcagaagtaatcccagctagaatgccttgttgattgagaatatcaaccacgatttctgcttcaaattcaacggatttatctttagcaatttcccagcttaccggcatatagtgacggtgatccgtcgcagcttctttcacattgcggcacgttaagcagtgaaccattaaccctttgcccgaactgatatgcgcaataatttcatcaccagggacaggtaaacagcatttcgcaaagctaatcaaaccgctatctaccccttggattgcaagagattgattattttcaggattaccgtctgtatcaatctctaaggtcttactagataagcgttgagcaatcactccactaatttgattacccaaaccgatttcggctaataggtcatcaaaattggataattgtagatctgttagcaatgcctcaattacaacgggatcaagatgttcaaaattagaggtattaagtgagagcaataattgtcgtcttccaagagaaattgcctgtgtacgctgctggttttttaaggtgttacgaatacaagagcgtgcttttgccgtgaccacaaagttcagccacaatgcatttaaccgtggactttctgccgtttgaatttcaatggtttgccctgattgtaacggctgagaaagtggatacggctgatgatcgaccactgcaccaatacagcggtcgcccacatcagtatgtaccgcataggcaaaatccacagcagtcgcattggctggaagctgtacgatacgacctttcggagtaaagacataaatgtcgcttgaaaacagatcagatttaacgttttcgataaactctgccgaatttcctacattttgttgcatttccacaatactttttagccattgttgcgtcctgacttgaacactcatattagcttgttcttgatagccccaatatgcagcaacaccaaaacgagctgcttgatccatctcttcagtgcgaattaatacatcaacaggcacacctttaggaccaatcattgaagtatgtaaagattgatagccatttgttttaggaaccgcaatatagtcttttagttggaaaggacgaggtttatatagactatgcatctgccctaatactcgatagcaattatccacactatctacaacaactcggaaagaataaatatccaaaatagaattaaaacgttgtactttttgcagcatacgtccataaagataatagagatggcgttccttaccatacacacgggctttaatccctacttcatcaaggcgaatttgaatttcctttgaaatttgttcaatcagccctcgacggcttcctctagccatatcgactgctgcttttaacaccttataacgataaggatacattgcttctaaacagagatcttccaattcatttttgatatgttcaatgcctaaacggtgagccaacggcgtatagatttcaatggtttctttcgcaatacgttggcgtttatctggacgcaatgccccaagggtttgcatattgtgggtacggtcagccagtttaatcaatacaactcgcacatctttggtcatcgccaagatcatttttcggaagttttctacctgtgcttcttggcgagtacggaactttaatttatccagttttgatacaccttgcacaatttctgcggtgcttgtgccaaactctgcggcaagctgttcttcggtgtaaggtgtatcttcaattacatcgtgtagaagtgccgccattaccgcttcgtgatcgagtttcatctcggcgataatacacgccacagcgacagggtgagtaatgtaaggttcgccacttgaacggaattgcccctcgtgtgcatcacgagccacaacaaatgcccgcttcacaatatcaatttgatccgcaggtaaataaccttgaataatggtattaagactttcaaataactgcactttacacctcacacaacaaaaactgagatttcgtaatgtataacgaaaaatggacaatgaaaagggcaaattacccttttgattgtccatttttaacaaaatttgatctaattatgaatttgcttgcacatcagccaagaatgaaatagcttctttctctgccacttcttgtgcgattacatcaaatttctcttgttgatccataatttgattattaatcaaaccttcttcaatttcacgcaatgcgataactgttggtttatcgccctcttcagccacaagcggctcacgagtgtgaagttgaagctgtcttgcacggcgtgctgccgttaaaatcaaatcaaagcggttaccaattttctctactgcatcttgaacggttacacgagccattgtttactccaaattttgcaaaattctgaacttgtaaaagggtgaagattatacagaagttgtataaggctggcaatgatagagagggaaatctttatagagataatagctctatttgtaaataattttgctgtagttaaattttgtaaaagatataaactcatatagcctattttatctctcctcgctgttttctcattttagtgtatcttaggttatcggttttcattggaacgaaaattgtaggaatatcattgctccactattttcctctatcagataattggagagaaccatatttgtcatatcgaatcaaataaaagccccgattatatttcggggctgttaatctaaagaataattagaacttcgctaaaagcattgcttctaatttctcttggtcaatcgcaaatttacggataccttccgctaatttctcaactgccattggatcttggttatgttcccaatagaattcagcttctgtcattggtgctggacgagctttcacttcacctttgtactctaacttacgcactaacggtgcttcgctttcttgtaactcttttaatagtgctggtgcaattgtcaagcggtcgcaacctgctaattctgtgatttcacctgcgttacggaaacttgcccccatcaccacagtgttatagccgtgttgtttgtagtagttatagattgaagtcactgaaaccacacctggatcttctgctggtgcatactctttcttatcagaatttgctttgtaccagtcaagaatacgacctacgaatggcgaaattaagtaaacgccagcttctgcacaagcacgtgcttgagcctgagagaataatagcgttaagttacagttaattccttctttttctaattgctctgccgctttgataccctgccaagttgaagcaattttaattaagatacggtcgttgctgatccctgcttcgttatataacgcaatcagtttgcgagctttcgcgatagttttttccgtatcgtaagagtagcgagcatcgacttctgttgaaatacgacctttcaccacttttaaaatttctaaaccgatatttaccgctaatttatcttctgcatcgatcagttgttgtgccttatcattgcttttagcttttgcataagcaatcgcttcatcaattaatggagcatattgaggtagtgcagatgcacttaaaactaatgatgggtttgttgttgcatcttctggttgatacgctttgattgcatcaatatcaccagtatccgcaactacgacagtcatttgacgtaaagcatctagttggttcataaaaagttcctctataatataaaaaacaccgcctgtaataataacagtaactgcttaaagcacctagtatgaattaagtaacgagattatattttacaatatgttaactgggtactatttcttttcattccaaggtgctacccaaaacaagcataacattcctggaatcgctaagaaaaagcagatccaatagaaatggtagaagccaacgctctcagctaatgccccagatgtcgcaccaatcaatttacttggaatcgcggttaagctggtgaaaatcgcaaattgtgttgctgtataaagtggatttgtttcacgagaaatataggcgacaaaacaggctgtgcctaagccaattccgatatattcaccaataataaccgcagataaagcgaagcgttcgtaagtaccgattgtttcaaacttaccgtgacttgcaagccacgcaaagccgagtaacattagcatttggaacacaccgaaaatccataaagagcgatttacgccaatacgcaacatcagcacgccacccaccatgcccgccacaatagaagcccatagtccgttgatttttaccgctgtacctaaatcggtgcggctaaagcccatatccagaataaaggcactttgtaaggtagccgcaaaggagtcgcctaagttataaagcaatataaaagtgagtgtgccaaccgccggccataaacctttacgttgaaagaactctttgaatggaataacaaaggcttcgtggaaaggaagattgcggttatcttgtaaaattgttggctctttcgctaagaataaactcagaataatcccagggatcataaagagtgcggtaaacaaaaagactgtttcccaaggatagtggtcagaaacaatcaacgctaacccacctggaattaacccagcaatacgatagccgttaatatgaatagagttacctaaacccagttcttcatcagacaaaatttcacggcgataagcatcaaccacaatatcttgtaccgcagacacaaaggcaactgcaatggctaacatcattacgggtttaatatcttgtgctggattgaagaagccgaagcaagcaattaaccccaatagagctatctgcgtgaaaaacatccagctacggcgacgaccaaggaaatttgggtaatagcggtcaaacagtggagcaactaaaaatttccaagtgtaaggcaaaccaacgatagcaaaaaaaccaatggtttttaaatctacctgttcagagcgaagccacgctggaattaattgatagataaaatataacggcaagccagatgtaaaccctgtaaagacgcagagcaacattttgtaactgaaaatttgccgccaaagagaaacctgtacttgctcgctcattattaccccttatatccattcggattatttttttgccaattccaagtgtctttcatcatttgcgttaaatcgtattgcgttttccaacctagctgttcaagagctttttgtggattagagtaacagaccgcaatatcgccagggcgacgttcaaccaatttataaggcactttaatgtcgtttgcttgttcaaaggcgttcaccatatctaacacagaatagccagtgcctgtacctaaattatagacgtggaaacctgcatcatcttgatgtttttccaacgcttttaaatgcccaattgccagatcaacaacgtgaatataatcacgcacgccagtgccgtcgtgggtttcataatcacaaccaaacacagacagttgttgcaatttgcctacggcaacttggctgatataaggtaataagttatttggaataccgttaggatcttcgccaatcagaccgcttgcgtgagctccaacaggattgaagtagcgtagtacgactgcactaaattgtgggaaggctttcgctgtatcttctaggatacgctctaccatatattttgatgtgccataagggttggttgttccaccgacttcacaagcttccgtaatcggaatttctttcggatcgccataaaccgttgctgatgaactaaacacaatcgtattgacattggcttttaacatctcttcaaccaacacaatggaacctgtcacattgttttggtagtaacgcaacggctctcgaacactttcgcctacggctttcaagcctgcaaagtgaataacagagtcaatctgattttctgcgaaaatgcggcgtaacatctcacgatctaaaatatcgccttgataaaagcgaacggattttcctgtaatctgtttaactcgctctaaagagatttcagatgaattagataagttatctaacaccacaatctctttgccttgatttaataattctactacggtatgtgagccgatatagccagctccgcctgttactaaaattgccatatgttatccttgttatgaatttttgttgattatattctaatatagtacaaattttaattaaaatttaatgatttactgttctcaattttaattttttaaataagagcttcttttgaatattatctaaaattaaatattctccaggagccagagaacctagtttgaagtaactgactccaaccctaactaatcttaatgttggaaatccgatatgagcagtcattctccttacttggcgatttttaccctcaacaatttttagttcaatccatgaggtaggaatattttttctttctcgaattttgggggcactttgccatttaaaatgaggatctgggataattttaactttagctggctttgttaagccatcctttaatattacaccactagctaatctattaagatcttctggttgaggaatgccctcaatctgaacccaatatgttttttctttttcaaacttagggtttgctaaacgatgttgaatttgaccattattagtcagtaataatagaccttcgctatctttatctaaacgtccaataggatagacatttggaatagaaataaattctttcagggttttgcatgcctgattgttagtaaattgagataggaccccgtaaggtttattaactaaaacaactattgtttcatcaaaagtcagttttgcgttattaatacgttgtactggtctaattaaggcagatttgagtttaaacataatgatttttagaaaagttttagagaagttgctggattctatccatactaagctattaaaacaatagaaagctgagatccaattttatcacttgcgccgactaaactgcttcagtagaatgtcaactattattcttttattaatatctaatggggtcataacatgtttggaaaaggtggcttgggcggcttaatgaaacaagctcagcaaatgcaagagcgtatgcaaaaaatgcaagaagagatcgcacaattagaggtcactggcgaatcaggagctggcttggtgaaggtgacaattaatggggcgcataattgtcgtcgtatcgaaatcgatccatcgttaatggaagatgataaagaaatggcggaagatttagttgcagctgcattcaacgacgcggttcgccgtgctgatgaaatgcaaaaagagaaaatggcaagtgttactgcgggtatgcaattaccaccaggaatgaagttcccattctaattatctagttaatcactttaaaagtaggggcaaattgcccttgctactatttatatcatatcacttatgcaaagtagccctttacttgaaaatcttatggaagccctgcgtgtattgccaggggtcggtccaaaatctgcacaacgtatggcgtatcatcttttacagcgtaaccgctcaggcggtgtgaatttagctaaagcattgagcgaagcaatgactcacattggacattgcaaatcttgccgaacttttactgaagaagatgagtgtgctatctgccaaaactaccgccgccaaatcagcggacaactttgtgtggttgaaatgcctgcagatattcaagcgattgaacaaactgggcaattttcagggcgttattttgtattaatgggacatctatctcctttagatggaataggacctcgcgaaattggtttagatttattacaaaaacgcttagaagaagaatcttttcaagaagtgattctggcaaccaatccaacgattgagggggatgcgaccgcaaattatatcgctgagatgtgttctattcacaatattaaagttactcgtatcgcgcacggtattcctgtcggaagtgaattagaaatggttgacggaacaagcctttctcattcatttgtcggaagacgggatatttctttataaataatttcttactagcctatcaggacgttttgctgtaaactacgctcccgtcctgatggtttattccattccgaatttcaactctatttatcacataaaaggcagacaaaatggcaacgaattatattttcgtgacgggcggcgttgtttcttctttagggaaaggcattgcagcggcgtcgttagcatcaattcttgaagctcgtggcttaaatgtcactattatgaagctcgatccttatatcaatgtcgatccaggtacgatgagtccaacgcaacacggtgaagtatttgtgactcaagatggtgcagaaacggatttagacttaggtcactatgagcgttttatccgtaccaaaatgaccaaagcgaacaactttacaagcggtaggatctactcagaagttttgcgtaaagagcgtcgtggtgactatttaggtgcaacgatccaagttattccacatattacgaacgaaatcaaagcacgagtgattgaaggtggtaaaggtcacgatgttgcaatcgttgaagtgggtggcactgtaggcgatattgaatcactgccgttcttagaagcattacgtcaattagccgttgatgtggggcgtgaaaaaacattgtttatgcacttaacccttgtgccatatatcccaacggcaggtgaagtgaaaactaagccaacacagcactcagtgaaagagttgctctctatcggtattcaaccagatgtattgatctgccgttcggatcgtatgatcccagcaaatgaacgtgcgaaaatcgcgttattctgtaatgtgcctgagcgtgcggttatttctcttaaagatgttgattccatctaccgtattccagcgttattaaaatcgcaaggtttagacgatttcgtttgtgatcgcttccgcttaacttgcaaagaagcagatttatctgaatgggaacaagtgctgtaccaacaagcaaacccaacgggtgaggtgactatcggtatggtcggtaaatatgttgagttaccggatgcttacaaatcggtcaatgaagcattaaaacacgcaggcttgaaaaatcgtttaacggtgaacattaaatatattgattcacaagatgtagaaaccaaaggtgttgaagtgttacaaggggttgatgcgattttagtccctggcggttttggctatcgtggtgtggaagggaaaatccgtaccgcacagtatgctcgtgaaaataaaattccatacttgggtatttgtttaggtatgcagattgcattaattgaatatgctcgtaatgttgcaggtttaactcaagcgaactcatcagaatttgataaacactgtccacaacctgtcgtgggtttaattaccgaatggcaagatgaatcagggaatgttgagactcgctcagatgaatcagatttaggcggcacaatgcgtttaggtgctcagcaatgccacttaatcgaaggcacaaaagcacgcgacgtgtatgggactgaaacgatcgttgaacgtcatcgtcaccgctatgaagtaaacaatacattacttccacaaattgaagcagcaggcttgaaagtgagcggtttatcggcagatcgtaaattagtcgaaatcatcgaagtgccaaaccacccttggtttatcgcagcacaattccacccagaatttacttctactccacgtgacggacatccgttatttgaaggatttgtgaaagcggcaaaagagcatcaaggtaaaaacgcttaatgattttaggcatagtagacaaaatggttgctatgccctttttttgtctactatgcctagccaaattcccctccaaaagtcatttttctttcaacttttagagggaaaacaacagctagtataaaaccctagccctaatagttccatcaatctctttcaagcgttttaatgcctcgcccgtttgttctgtttcaacgtcgataaccacataaccaatcgtcggatcggtttgtagatattctgcggcaatattcacattcgcatcaacgaagactttattgatttgatttaaaatacctgggcggttttcgtggatatgcagtaaacgttttgtgcctttatgttctggcaaggaaacttctgggaaattgactgcagataatgtagaaccattatcggagtatttcacaaatttacttgatacttcagtgccaatattttcttgtgcttctgatgtagaaccaccaatgtgtggagttaagatcacattatcaaattcgcaaagtggcgactcaaacggatcgcttgcagaagctggctcttcagggaaaacatcaagggctgcaccacgcagtttgtccgtttttaatacctcaactagtgcatcaatatctaccaccgttcctcgtgccgcatttactaatactgcaccttctttcatctgggctaaacgttttgcgtcaattaaattttttgttgaagcattttcaggaacgtgtaatgaaatcgcatcacaggttgaaagtagttcttcaaggctagcaacttgttgagcatttccaagcggtagtttattttcaatatcataaaaatacacttgcataccgatagactcggcaataatgcttaactgcgaaccaatatgcccgtagccgataatccctaattttttaccacgcacttcgtttgaaccagcggcagatttattccaaataccacgatgtacttccgcatttgcttttggcacttgacgcattaacacgatgatttcacctaacaccaattctgcaacagaacgagtatttgagaaaggtgcattaaacacagggatcccacgacgttttgccgcatctaaatcaacttgattggttccaatacaataacaaccaatagctactaatttttgagcttgttgtaagacttcatctgttataaaagtacgcgaacggataccaacaaaatgagcatctttgatcgcatcaattagctcttgaccatcaagagcttttttatggtattcaatgttggtatagcctgcatttttcagaacatcaattgcattttgatgaacgccttccagcagtaaaaatttaattttagatttatctaaagaaactttggttgtcatattgccttccttatacagaagagagttgagtagcaacccccaaccctccgtagtgatttttcttattcaataatttttgcaccatcaggcgtacctacgatggtcacattcgcataacgttgtgcaaaaatcccgttagtaacaacgcctgcgatattattgatggtatgttccatttttaatggctcaaaaattttgaagttatacacatctaaaatcacattgccattatctgttacaacgctttcacggtattcgggcgatccccctaaggctactaattgacgagcaacataagaacgagccatcgggatcacctcaacaggcagagcgaaagtagagcctaacacatctacttgcttacttgcatcaacaatacagatgaatttttttgcaagtgaactcacaattttttcacgcgttaatgccgccccaccgcctttaatcatatagccttgcggagtaatttcatctgcaccgtcaatataaacatcaagctcagtcacctcattggcactaaatacttcaatacctaacgctcttaaacgttcttctgaagcttttgaagctgcgactgcccctttgattttatctgccatttcacctaaggcatcaataaaacagtttacagttgagccacttcccacaccaacaatagtgtcaggtttaacatattgcaaagctgcacgagctgcaatttttttcatctcaagttgatccatagcgttctccttaaagcaaacgtttgcgttattatagtctaaaaaagaacaagcggtaagatccttacaaaattttgttgaaatcttaccgcttgcgattagttacgtttcaccgcttctgaaatctcttccgcacaactttgtgctaaagccccatcttcacactccaccatcacacgaattagcggttctgtacctgatttacgcagtaagatacgacctttgccagctaaacgttgttcaacatcttttgcaacagctttaacttcatcactgtctaatggatttgcaccacctgcaaaacgaacattgatcaacacttgtgggaataacggcacagctttagccagatcatttaggcttaatttatgtgataccattgcagccaatacttcgagtgaggcgacaataccgtcaccagtagtatttttgtctaacacgataatatgccctgagttttcaccaccgagcttccagcctttttcttttaagacttcaagtacatagcggtcgcctacatttgctcgtgcaaacggaatagctaactcttttaaggcaagttcaaggctcatattactcattaatgtaccaacgacaccgccgtgtaatttgcctgaacgtaatgcttcacgagcaataataaagagaatttggtcaccatcaaccttgttgcctaagtgatcgaccataattaagcggtcaccgtcgccatcgtaagctaaaccgacatctgcaccagcttcgactaccatttgttgcaaggctttaatgtccgttgcaccgcatttctcattgatgttcaaaccatttgggtgtgtgccaatttcgatcacttctgcacctaactcacgcattacgtttggagcaatatggtaagttgcaccatttgcacaatccaccacgatcttataaccatctaggcttaaatgtgatgggaaagtacttttacaaaattcaatgtaacgtcctgccgcatcattaatacgacttgcacgacctaattcagctgaagccacgcaatccatcggctgatcaagcattgcttcaatcgcttcttcgacttcatctggtaatttttcaccgattgcagagaaaaatttgatcccattatcatcataagggttgtgagatgctgaaattacaatccctgcttctgcacgaaatgtacgagttaagtaggcaatcgcaggggttggcatcgggcctgtaaaggcggcggataaacctgccgctgccaagccagattcaagtgcagactcaagcatataacctgaaatacgagtatctttaccaattaatacttgtttagagccttgagtagcaagcactttacctgctgcccaacccaatttcaatgcaaaatcaggcgtaatcggaaattgccctactttgccacgcaccccatcggtgccaaaatatttacgttctgccataaataattaccttaaaaaatattgatatgctggactatcattaacatcttgatagcgataacctaatcggtctaaatcttgtttaaatgcctctttttcactgccgttcacaacaaatgcagccaagatgtcaccataatctgcaccgtgagctcggtagtggaacagtgaaatatcccaatcaattaacgtttgtaagaacttcaacaacgcccctttctgctcagggaactcaaaactgtataattcttcttgctgaatagaacttgggcgaccgccgaccatataacgaatgtgggttttcgcgatgtcatcatcggataaatcggtaactggatagccattttgttgtaaatctttaatgatctctaatttttcagcattcccactaatacgcacgcccacaaagatacaggcttgctgatcgtctgcgtgacgatagttaaattctgtgaccgcacgattaccaataatttgacagaacttgagaaaagcgcctttttgttcaggaatagaaacggctaagagtgcttcgtgtttttcgccgatttcacaacgctctgacacataacgtagtgtgtggaagttaaggtttgcccccgataaaatacaggcgagatttttaccttcaagattgtgttgagccacatattttttcagtcccgctaaagataatgcccctgacggctctgccaccgcacgcacattctcaaacacatctttcaatgccgcacagatttcatcgttatcgactaacacaacatcatcaacatacttctgacacaaacggaatgtttcatcgccaatacgtttaaccgcaacaccatcagcaaataaccccacacgttctaaatcaactggttgccctgcttgcaaggcataaaatagacaagcggaatctttagactcaaccccaatgactttaatttcaggcatcaattgcttaatcagcacagcaatacccgcaatcaaaccaccgccaccgacaggaacaaaaatatagttcagatcggcattttgttgtaataattccataccgatagagccttgtcctgcaatcactagcgggtgatcaaacgggtgaacaaaggtcatattcagctcttgggaaagctcaatcgctttggctttggcttcatcaaaatttgctccatggagcaacacttccccaccaaaaccacgcaccgcatcgactttgattgacggcgtattttgtggcatcacaattaacgctcgcaaaccgagatgtttcgcagacaaagcaacaccttgagcgtgattaccagcagaagccgcaatcacccctgcatttttctgagctggagagagattagaaatcatcgcataagccccacgcagtttaaaactatgcactggctggcgatcttcacgtttaatggaaatatgattacccaaacgctctgagagcttttccattttttgtaatggcgtgacttgggcaagatcgtagattttagagcttaaaatggcacggaggtaatccgtgcctgattgtaatggggtatcactcatcgttcaaccaacctttaattagtggttgcaaccacaaccgccgtgtccgtgatggtgatgatcgtggtcgtgatgaccgccacagcaaccgtgatcttcatcgtgatcgtgaccacagcaaccaccttcttgatgaacgtgaccgtgagcaatttcttctaatgtcgcttcacgagttgcaaccacttccacagagaataataactcttgaccagctaacatatggttaccatcaacaaccacttcatcgccatcaacttccgtgatcaccacaggtaatggacctaaatccgtatctgcgataaaacgcatacccacttctaattcatcaacgcccataaacacatcttttggcacacgttgcaccatattttcattatattcgccgtacgcttcttctggtttaacacgcacttcaaaggtatcaccaaccgctttaccttctaacgcattttctaaaccaataacaaggttattgtgaccgtgtaaatattctaatggttgctcaactggtgcttcatcaactaatacgccatcttgagtacgaacttggtatgcaatgctaggcacgacatttttagtaattttcatttaagtatccttattttattaggtaaaaaattctaggcattgtagcttgttatagaggatttgcaaatgttagtaacaaaatgaccgcttattcttacaagcggtcaaattttgcaattaatccacaatatcaggcgtcaccgcatcaaccacatcaacagcagttccaacgacaccactgacaacagaagtgactaaacaaccacttaccgaagtacaaagtaaggtaagaccgagcaacttaatccactttttcattttaatccttatctttcaaatttcacctgccccgaggcaaaagcagaaatagtggctttgcctgcttcaagtggaatgtccatatctgcctctttcgcataacttgcagatcttaatgcaactggacggttataatgctcttgtccattcggggtttctaactgaacattgctgataatataacgtttcgcatttagccctttttgaataacttccgctttacgctgaaattgagcaataatgtctaacgtcatttcatcttcaagagaagctaatttttcaggcgacacactaaaatgaatttgaccaatcgccacatcatcgcctaaattctcaagcacctttgccatagcgtcaaaatttttacttttcaactgaatgcgaccttctgcgaaccagcctgtcaccttacctttattatcgtattctggatagttactaatgccatctgtagataactcaatgcttttatcttgtttcgctaattcaatcacctgattgagatgagcagaaacttgctttttcagttcattcaggtttttacctgacattctgctatatacctcagctttcatcagatctttatccaccgcacgacttacttgcgttgaaaactggaaagtcgagttggtatcaaaggtatttggctctgccgatacagccaatgaggtaaatacaagcggtaaaatggctaaatattttttcaatgtcattctctattccttttatatcagggcgtaaaacaccacttagaacgtatttctcttgattagttcaatgtttaaaatatgtgcaagatcctgtcgcaccttatctatctgccaagtcacgttatagccagccaagtgcataccataaattcgctcacttggtttactttgctgatatgcgggtcgagggtcttgtgcaaccacatcacataaaaattgcacaggatcttcaatgccaaatttcgcaaagttctgacaagatttgaccgcttgtagtgcttgctcagtcaaaagcacttgcaatttcacctcaggtttatcttgagcaaaccccgataacgcattcggttcactatcagcataagcaacgtaaggtttaatatccaaaatcggtgtaccatcgactaaatcaacactgcctaaatgtaaataaacctcgccctctttaacttcaatacgatctaatgctaccttcgataaacctaacggatttgggcgatgtgtcgcacggctggcaaatacaccaacacgctcattcccacccaaacggggagggcgaacagtagcgtgccactctcgttcaggaatttgatgaaattgaaaaataagccaaagatggctaaattgctccaaacctcgtactgcatcaggcgtattataaggtggcaacaaacgcaaaatacctcgcccttcacggactaaattgggctgacgaggaacggcaaatttttccccataaggtgtttgtatcgttccaatgggagaaagggttaaagaggacggatttgtcataaaaaggcaaattttctgttaaaaatcaaaacatataagaacattttgtaataaaatacacagtcttaaaagaaaaacttcattaaagtgactaatttattgatatgaataaaggttctatgttctctatttggctttcaacggctcgcccaaaaaccttaccgcttgcattagcttctattttggttggttctgcattagctttttggcaaggaaaatttgattggctaaccaccctactggcttttatcacaacgattttgttacaaattttatctaactttgccaatgattacggcgatcacatcaaaggttcagatacttcagaacgaatagggcctttacgtgcaattcaacacggggcaattacgggtgaacagcttaaaaaggccttaatctttgttgcgatactctctttcatctcaggctgtggattaattggttatgcttatcaaagttggcaagatcttgtagtttttgcactacttggcattttagcgattgttgcagccatcacctacaccgtaggaaaaaaaccgtatggttatttaggcttaggcgatatttccgtactcattttctttggtttcttagccgttttaggcacattctacttacaagcccatactctgcagtttgatctattactccctgcttttggctgtggtctattatctgtagctgtattaaatatcaataacttacgcgatattgagcaggataaacaagcgggtaaaaataccctcattgtccatatcggtagccagaatggacgccgttaccatcttcttttactcagcttagctgtactatcctatcttttattcaccctaatgaattttgctcattggtacaatttcctatacttattggcaatccctttgctagtcaaacacggtttatttgtttaccgacacaaacacccaacagaacttcgccctattcttgggcaaatggcaggattggcattgataacaaatttgctgtttgggttgagcatcatgttataaatatgggattaactggcttacagtttatatatctttatagcttctccgctttctctggcagtaacacaggaatgccattttcaattgggtaagcgacattcgccgaacggctaattaaacggttgttttctttatcccactctaattttgtttgagtgattgggcaagcgatagtattaagcagtttttcgttcattctgttttctcactaattcaaggacgggttctaataaacaagcgggatcttgtgctgaaaattttgcagaaacaggcacataccaccaattcggttgagcaaagttacggcattttactgcatctttttcggtcattaatagcggtaaaccgtctttctgcaaaggttcgatgatttctaatgcgtagggctgatgatcagcgaagccatagctttctttaagttgaataccaagatcttgcaacatcataaaaaaacgaggtggatagccaatgccagcaagggcaatcactggctgatgacaaaaatcggctatcggttttttctcccctgtttttagattgatcacccactcaggttctaactgcattagatgttcgcctgcttgtgcagattttccgttgcaaatcaccgcttgcactgattttaaacggcttggaagctctcttaagccccctgctggcaagacaaaaccgttgccaaaacgacgctcgccatcgacaacaacccactccatatctcgttcaagggcgtaatgttgtaagccatcatcagtgatgattaaatctaactcaaattggcttaataatagctcaatactttgtcggcggttcggcgaaacagcgactggagcgagtgttcgttgcgcaatgagtacaggctcatcgcccattagttcgggatcgctatcggcagtcactaactgtgggaattgcttattctttccaccataaccacgcgagataaccccaactttcacgccacactgttgaagctgttcgaccaaccatacgaccacaggtgttttgccatttccgccaacagaaatatttcccaccactaagactggcactggcgagcggtaagatgttaggatttttttgcgatatagcatcactcgaatttggctaatcaaccaaaaaagcagagagagtggggctagtagccaagtgatgagggattttgtttgccagatgttcatagttgttatacgtaaagtcatttatatgtttctatgatgtactgtccattctatggcatcaaataagtaatgtctaaaaaataaattatttttgtaagcatagggcgtgttgatcttttaagtacaaaaaacaaacgacatagaaatttggtataatttagttcgccaaaacctaaccatcccatacaaactatgtcgcttagaacgattttaacagataatctttggaaacgcctagcttatttacttgaccgtacaggacgtgtttataataaacctgaacatcgtaatacagtggaagggattttatatcgcattcgtacgggatgcccttggcgtgattcacctgctgaatttggcttgtggaacacgatttatcgtcggttcaatctttgatctaaaaagggtgtttggcaagaagtgctaaaatcatttagacaacatattgattctgaatggatttttattgatagcagtgtcatcaaggctcaccagcattcaacaggcgcaagcggtcaaaatccgcaagcgattggtaaaagtagttgattccagcatagtatgactataaaataaataataatcattatcaacttatacataacaacatgaactcttatagacaacaaatcacccagcttcttgctgaaaaaccgaatatgattacccttgaaattgcggaaaagttagatctcccagaagggcaagtgctttgcaatttaccaagtgaatttgtccgcttgttctctgcggatagagcagaagagattctacaagcgatcagtcaatggggaacatttacaactatcatcgaaaaagaaggttccatttttgaaattaaagaccgttttccaagcgggatctttgctcgaggttattacaatttgaatatgaaggatcaagaaggcacacttcacgggcatttaaagcttgataatattgctcgaattgcctttgttagcttgccgtttagagggaaagaaagctacaacattgcttttattgcacataacgggcaaaccatttttaaagtgtatctcggtcgagatgagcagcgacaactcttcccaacacaagttgaaaaatttaagacatttcaataaaaaggagcgataaatgtcaaatcgtcaagaagtattacaaaaccgtttaggaccagaaattcaagaatttaaagcaaaaatgaaaacattggtgcttgccactgtggataaagagggaacacctaatgtgagttatgcaccatttgtgatcaacaatggtgaatatcaagtattgatttccaccattgcccgccacgcacgcaacctacaggaagtgccgaaagtatcgttaatgttgttggaagatgaaagtcagagccgtgaaatttttgctcgccgccgtttgaccttcgacgcaaccgctcgcattgttgaacgccatagtgaagagtggaatgatggcattgccaaattaaaagcccgtcatggtgatttagttgatgagttagcaaccttacaagacttcaagctgttctgctttaaaccacaacaaggattatttgtaaaagggtttggtaaagcgttccaagtaagtgctgatgaattagtgaattttgttcatcttgatgaaggacataataaagaaatcggtccacacgagaaagaggcataaaacacaagcggtcagttacagtaaatcctttaccataactgaccgcttgtctattgatggaaactactcagcgtcttctttcgcccattctaatgaacgtttaaccgcacgtttccaacctttgtagcgttttgcacgtttttcttcatcgctgtcaggtgagaaggttctttcgatttctgctttaccacgtaactcttccaagctgctccagaaacctgtcgccaagcctgcaaggtaagcggctccaagtgcggttacttctagcactctcggacgttctactttggcattgagaatatctgcttggaactgcattaagaagttgttcgcaactgcaccgccatctacacgtaaagttgctaatttcgcaccgctatccgcttgcattgcgtctaacacttcacgggtttggtaagcgatagattctaatgttgcacgcacaatgtggttacggtttgcaccacgagataagcccacgatagcaccacgcgcataaggatcccaatatggtgcacctaagcctgtaaacgcaggaacaacatatacgccatttgtactgcttactttcgttgcaaagtactctgagtcacgagcgtcgtggataattttgagttcatcacgcaaccattgaattgaggcaccagccataaagattgaaccttctaaggcatagcaaggttcacctttggcgttacacgcaatggtggttaataagccgtttttcgattcaaccgcttgatcgccagtgttcatcaacataaagcagcctgtgccgtaagtattttttgcttgaccagattcgacacaaagatgtccgtaaagtgccgcttgttggtcaccagcaatccctgcaacaggaatacgcacgccgcccataccgccaatgttggtttgtccgtaaatttcagaagaatttttcacttcaggcaacatttcacgcggaacatctaataattccaacattttgtcgtcccactgttttgtgtgaatgttgaacaacattgtacgagaagcgttggtgtagtcagtgacgtggcttcttccttgagtcaatttccagactaaccaagtatcgaccgtaccgaataacaattcgccttttttcgcacgttctcttgcaccttctacattatccaaaatccatttcacttttgtgcctgagaagtaagggtcaaccactaaacctgttgttttacgaatatagtcggcgtgaccttctgcttttaatttttcgcagaaatcagatgtacggcgacattgccatacaatcgcattgtaaatcggtttacctgtttctttttcccaaacaatcgtggtttcacgttggttggtaataccaatcgccgcaatttgatcggcttttaccccagcttttgcaacgacttcgtttaaagttgaactttggcttgcccaaatttccatcgggttatgttcaacccaacccgcttgcggataaatttgagtaaattcacgttgagccacttcaacaatgtttgcatttttgtctaataacaccgcacgagagcttgttgtaccttggtctaaggcaatgatgtattctttagtcataggatcacctctgaaaattatttacagttgcacggtaaattcttaccaataaaacgagtatagataaagccacctaataaagaccaaaaataggtactaggaaataaggaatatcacgtccgccagtgagtgctatatcgccccaaccagctaagaatgcaaagagttttgagccaaaatcacgagcagggttcatcgcaaagccagttaatggccccattgcaccaccaatagtcgcaatgagtaaaccgataagtaaaggagccattgcacctctcggcaaaccgttaccatcatccgttaaagcaaaaattaatgccattaatacggcggtaatcaccacttcaacaaagaaggcttgtaatacgctgatatgtggatttggataggtcgagaaaacacctgcaaagccgataccttcaccacgcacaatattttgtgccgcttcactggcagcaaaaagatctttatataagaagtacactaatgctgccgcacagaaagcaccgagcatttgagaaataatgtaaggcagaattttttgccatcaaaacaagcgaatttccataacgcaatagtaacagcagggtttaagtgagcaccagataaccccgcagaagcataaacagccattgcgaccgcaagtccccacacgattgaaatttcccacaagccgaatgtggctccagcaacctgtgctgcggcaacacagcctgccccaaaaaagataatcaaacctgtaccaataaattcaccaatacaagcagcttttaatgatttgtccataaattccccctaaggaaattaaattagaaagtaaaaatgtttgaaaaagaaagttttctaggatgagatataaaaaaaagaacattttacgcaaacaattaaataaaaatttgtgaagttgctcacaattttttaaaaaagaaagtgatttttgtgaaatgttaatatgtatcccaaatacgttacaaactttatagccgttttgttagataaaaataagcatatttcattaatctcaactgtcgtttccagcgagtaggctgatgtaaaatacgaaacaaccactccaaacctaaattttgccaacatttaggagctcgcttaaccttaccgacaaagacatcataagtgcctcctacccccatatatagtgcatcaggataaagttgctgagctttttgcataaatttttcttgttttggcgagcccatcgccacggaaataaatttcgcaccactcgcttttattctccggataatttcttcttcctgctctttagcgaaataaccattttgtgttccaaccacttttacttgccattcctgcaatttcattgctgttgcttgtaaggtatcctctgagcttccaactaagaaaacaggtaaacagcattctcccaactcagccatcaatctctcccacaaatcagcgcctgcaatgcgttcaattttcgaatacttcggatatttagatctgatagtacaaactacacttattccatcggcatatttatattcagcctcctctaatagccttttcatttcattatcttcttgataaatcataattttttcagcatttattgctatcaatttacctgttagaagaactccattattcaataaataggctaccaaagtttgctgattttcaacggctaataactcaactccaccaactgatactttattcatacccctctctcaccctatttatcaaataggctactatataagcaaatacaaaaatcacactaaagaagcagaaccgtgaaataaaagcatctatgccttctcgtatcaatacaatcaaattgaacaaatttgccaaacaataactttgaataactgcagaattttttccataggcaaaaaaattatcaaagatacgtattaaaccaccaaccaccgccattcctatagcaatcattggtatcccccccataatataaaaagagcctaataacgttggcgacatagctaaaccagaaaagttacctaatacacttttcgtgaaatagtttgctgtattccacacgatgtctgggcgttcctcccataatgattgaggaatatacacataaaaatcacgcacgataggcattaatccttgaaactcaatctctgcatccattatttttgctacattttcccaaggcgaaaaggtatcacgtgtcaaataaagaaaagtgtaaaatgcttccgaaccttgtacattaagccgataccgccataatgccaacaaaaacattgcaataactgtcaaaagccctgccctcaccagccatttaaatgataaaaacctccgcaaataccccaacagcataaacataacaaaggctaatgcaaggttagctcgtgtgcccccaacagctaggtaactcaacaccccaaatgtcattccagctaccaaaaatagccaccaactttctttagtaggctttaagaaaaaccaaattaacaaggcgggtaaaaagaaataaaagaaacgttttaaagccacaccactaacttgagcagaaaaaatgtggctatatttttctaatttgaataacaatagcccttgatttaacaacataaatcctaataggctcagtattgcaatcatcattaaaatccaagcggtcagatcagctagcgattttacctccaccgcataccttggtatttgcttatttctccctatataaagataactcacgtaatagataagatagccacctaaagctattgctagtacgttccacaacattgagacgactggaaggcgatattcaaatagccctgccatcgtcatcgaaaaaggaaacccaccgaaaaaggtaataagatagatgccactaaacagcaaatggaatgaaaagccttgctggcgataatctcgttgaattatccaaaccaacacacttatagcgattacataaaaaaggattaatcccgctaacatgttaatgttccttaaacaaggtgggtaatttttactgaaattataccgcttgtaaaccaagagaatgtaaacagttcagccattcttgcttataacttagggggaaaaaagtaattttacttttatcaagtaaagccaactgggatttaactcgtataatctctgagtcactgatttcatctgcgaaaagaaagctaattccctccgcttgtaaatcttgttgaaaaggatttgctctatgaatggctatcgggatgttcatctgtatgagtaaacacatcgttccgatcccttgctgacgctcaaaaggaaagtaaccaagatcacattgagacagtagatccagataagcctcaaattctaattcctgagtaagaatgtccacctgcccttgttggaagtattgttctgcttgttggcgaacttgagcaatatattttgaattacctgcgggataccccatcggcacgactattcgtacattttcgccaaatatctctcgaatttgctttaatccaagtaaatgttgattgctcggatcgccagaatttcctaacaaaattgtccgttgatatgaacattttttagttggaaaattcgtaggcattctagttggaaaataaagccgttgatcaagagagctcttacgttttaattgttgataagcgtgatttaaatctcctaaagttccccacaagcgtgctattttacgttgtgcaagtcttcgcaatggataaaacaatctaaactttaaagaagaagagagctcataaagatctgctccccaaatatgccaaacacaacgatttgctgggactaatcctaacaagatagctaaccacaacgatgtattgaattgcccatgtagcacaaaccaagcggttggttcctttcttgcaattttgataacttcttgagtgagtaaatattcatctggatatgaattaatatctaataatgtaaaagtttcagacaaatcactacgactaacaacataaaaatgaaaagcattcggtagttcatccaataattcattttggaagaaatttagtattgtgtgattgtgatggggaatattagcccctaaaacatggattatatttgccatattccatctataccatattaaaaagaatagtcttgatgtgacatataaatcactatttaaatgttgccaagtgttcctatgatatttaatcctttgacccatgctttaatattcctttcacattaatgacattatctataatttttggtaaatatattgagcaataatagagaaatatacgtgagatttgaaaattttcctgtaaaattttacctcataagttgaataattatagccagccataatgttaaatacaaaagaaaaacagaaagaacccatagcgaaaaagccctactttatcccaacttgcttaaaactagctctcttagccacttgctatgttgggatatacggcatctatttagatggaaaaattcgttctaaaatggacgggcaaatttggcaattgcctgccgaggtctatagtcgtatcgaaagtgttcgccttgatgacaatcttacccttgagcaagtcaaactcaccttgttagacaatggctatcgtgaagtttcattaattgcaacaccaggtgatttcaaaatcgaaggtgacaatcttgttttgcttcgccgtgcttttcctttccctgaaaatcctgaagctcaacgtgtactgcgtttacgctttgtcagtgataaactcgctcgtattgaagatttagtgcaatttaaagaggtcaaggaatttcgtcttgaccctaaaatgattgcaatgttgcattcggataacgatgaagaacgtcaagcgttacgtttgcagaattatcctcgtctgcttattgatgcgttgctacttaccgaagataagcgtttctatcaacacgaaggaattagtccactggggattgctcgagcctttttgacaaactatcaagcagggagaacagtgcaagggggcagtactttaactcagcaattagttaaaaacctctttctaagtaatgaaaaaaccttagtgcgtaaagtaaatgaagcgttaatgtcgctgattttagattttcgttacgataaaaaccgcattctcgaaacctatctaaatgaaatttatcttggtcaaaatggtagttatcaaattcacggttttgctctggcaagtcaattctattttggtcgtcctattcaagaaattaatctaaatcaaatcgctctgctagtgggaatggtgaaaggtccgtccctctataatccgtggaaaaatccagaaggggcattagaacgccgtaatgttgtgttgcgtgtattgctagaacataaggtgattaatcaagaattgtataatttacttagtaaacaaccgcttggcgtgaaagagaaagggaatatctatcgtcagcaacctgcgtttatgcacgccttaaatttagatattaaaagtcagttgggtgagaacaaatctgctctgctgtcaggggcaaaaattttcacgactttagatagaaaacaacagcgttctgcggaaatggcggttatcaatggggtatccgaattagaaaatagcagtaagaaaatcaaagagttgcaatctgctattgtggtggcggaatataaaacgggtaaagtacgggcgattgttgggggagttcagacacaatatgctggttttaaccgtgctattcaaaccaaacgtcaaatcggttcattggttaaaccgtctatttatgccattgctttggcaaatccgcagtatttccgtcttaacacgccgatagctaaccaaccgattaccattaccgttggaagtaatacttggacacctcgtaactatgatcatcgttttagcggttctgtgatgttaatggacgctttagttcgttcccttaacattcctacggtaaacattggaatgaaacttgggctgaaaaatgtgattgccaagcagaaagaaatgggctgggataatgccgaaattccgccttatcctgcgacattgctcggctcttattctatttcaccttatgatgtcaccaagtcttatcaggttattgcaaatgctggcttaaaagtaccgcttacaacaattgaagcgatcatatccccaacaggtgaaataatttatcagcctgttctcacgcagacaagtaaacgcgttttgcctgcagaagccacaattcaaacactttatgcaatgcaacaagtgacggagcgaggtacagctcgtagcctacaggcagattttgcacaactgcatatcgcaggcaaaaccggcaccaccaacaatgcacgagatacttggtttgtcggcatagacggtgaaaatgtcacgaccgtttggttaggtaaagataacaatagcgatacctatctcaccagttcaagcggtgcgttgcaaatatataaagagtaccttaaacgtgccgaacccttggcgttcaagctaccaagcataccaactattcaatgggtaggtatcaacagctacggctcttgggactgctccagccctcgtcaaattcctgtttggaaagataaaggacaacgctattgtacgggtggcggttctatggttgaagcaaaaccaagtgtgtgggacgcattatcactaggcaaagacgtccctcaaacccaaccgaataaagccgacgaagcagaagggcaagctccgattgaggaagaaccattagaggaatagattaagaacggcatagtagacaaaaattacgggcaaagggtcattagttttcatctactctgccatatcttacaattcttacgctttttccgcctctaatctttcaaaagaaagcactttgcgttcaagtctgcgtaagattacggtcataatccctgtaataaccaaataaactacaccggctaaaccataaatggttaatgcatcatactctgtaccataaagctggcgagcatagcccataatatccataatggtaatggttgaagccagtgatgttcctttgaatactaagataatctcattgctgtaagacggtaatgcccgttttaatgcataaggaacaaggattttcaaggtctgtaatcgacttaatcctaatgcagcacaagtttcccactgcccttttggtatcgctttgaccgcaccgtgaaatagtaaggtggtataagcagaactatttaatgcaagggtgagcattgcacagaaccacgcatctgataacaaagaccaaaatggacttgcgacaatccaaggaaactgcccaggacctgcataaatcaagaaaaactgtactaacaatggcgttccagtaaatagggttaaaaagccatttactattccttttactagacgattttccattgaaagtaaaaacgtcattccaacagcaagaaaaaatgccacgattaaagaaacaaacgtcagcaataaactagtcgggataccctgagctatcaccataaagtattcttgcaacattatttaccccctctttcaaaacgagtgaagcgtagctctaatttacgaataattacttggctgactaatgttacaccaaggtaaattaatgctgctgtaccgtaccaagtaaatggctgatgggtactggtgttaattaactccgtttgtcgcataatatcgtgtacaccgattaaagaaaccaaagcggtatcttttaataacactaaccactgattgcttaaccctggtaaggcgtgtcgccaaacctgtggcatcacaatgtttacaaaagtatagccacgacttaatccaagagctgccccagactcccactgcccaagcggaatagcttgaatagctccacgcaatgattgagaagcgtaggaagcaaaaataatagatagtgccacgacaccacagccaaatgcaccgagttcgacatattcccctgtgatcatttcaagcacttcaggcgcaccaaaatagattaaaaagaccactaaaatttcaggcaaaccacgcaataacgcaacaacaactgtggttggtttacgcaccattgtccatttatgcgtttcaagcaccacaaaaagaatggacaatagtaatccgagcaataaagagcaaactgccaaccctaaggtcattagggttgcagaatacaatagaggaagataatccaaaaacataatgattatttagtcatccatttatcataaattttttggtactcaccgcttgctttaatcgctgcgatacctttgtttaatttttcaactaactcagtgttagattttttcactgcaatgcctaagccattgttgaaataacgtttatctgtcactttctcgccaacaaattgtgcttcagggattttgcctaacatatctcttaacacatcagtgtcaccaaagattaaatcaatacgaccattttttaagtctaagattgcatcttgtaaactcgcataagattttgcttgatattgtttagcttctgccgttgcgtattgttggtaagttgtaccgttttgtacacctactgttttagcagatgctaaatctttaccttgtaaagcaatatagcttgctgaactttcgtagtatggtgctgagaaagccacttgttttgcacgagcttctgtaatatcaattgctgaaattgccgcatcaaaaccgccacgccctttaattaagctagggattaacgcatcaaacgattgagatttaaattcgcaagtcgcttggacttctttacaaattgcatttgcaatatctacatcaaagccaacgatttcacctttctcattggtttgctcaaacggtggatagcttggctccattgcaaacgtaattttgtcattcgcataagctgaaactgctgttgctgccaaaatggttgctaaaagtaattttttcatagtaactcctattaattgtatgatgttgtgattaatctgaatgtgaaagatattgagcaaattgcgttgtttttggttgttcaaaacagcttgcatcgcccatttcaataattttgccttgttccatatacaccactttagtggcaactttacgagcaacagaaacttcgtgtgtcacaatcacttgggtgatccctgtttgttgtaactctttaataatatcaaccacttgagcggtaatttcagggtctaaggccgccgttggttcatcaaacagcaatacttccggttgcatcattaaagcccttgcaatcgccacacgctgctgctgaccgcctgaaagctgtaacggaaaacgctctgcaaatgcagtaagttgcaaacgtgctaacaaacctttggctctttctaccgcttgctctttcgttaaacctaatactttcattggtgcttcaatcaagttttgcattactgttagatgtggccataaatgatattgctggaacaccattcccacttctttacgtaataatgcaacctgtttcgcattggttttagcggtcagatcaaacttatgatttgcaatctcaagctgacctgattgcggtacttccattaaatttaaagtacggattaaagtacttttccctgctccactagggccgagtaacacaacggtatcgcctttttcaatgtttacattaatatcaaacaaggcttggctcgaaccgtaaaagaaattgacattactaatgcgaattgccattaactacttcctatcaaagttttaaaactgaatagatattaaattttattgcataactatgcaagtgatttttgtaaatttgaggtaaaaattttgatgaaaaaattaaaatacatatctgtaattgtaggttataataatcacactgtataaaatcacataaagaggcggagatggatttttctttattacttgacggcttaaacgataaacaacgagaagcggtagcagcccctattggcaactatttagtgttagcaggtgcaggtagtgggaaaacccgtgtgcttacccaccgtattgcgtggttaattggcgttgaaaatatcgctgagtccaatattcttgctgtgaccttcaccaataaagccgcagcggaaatgcgtcatcgtattgaatataccctatcgcaatctagcgaccaccgcttattcggtatgtgggtcggtacattccatagcattgctaaccgcttacttcgctctcattatcttgatgccaatctgccgcaagattttcagattatggatacggaagatcagcaacgtttgattaaacgcttactcaaattgcataatttagatgaaaagcagtttccaccgaaacaagtggcgtggtttatcaatgctcaaaaagatcaggggctaagagcaaaagatctcaaacaatctcacgatgatccccattcacaacagctcgttaaattctatcaaatctatcaagaggcttgtgatcgtgcagggttgttggactttgcagaactcttaatccgtgcttatgaattattcaaatataacccattgattttacaacgttatcagcaacgttttcagcatattctgatcgatgaatttcaggataccaataacattcaatacgatcttattcatttattggcaggaaaaacgggcaaagtaatgattgtgggcgatgacgaccaatctatttacggctggcgtggtgctcaagtggaaaacattcaacgcttcttaaatgattatgacaacgcacaaactattcgccttgaacaaaattaccgttcaacaggacatattttaaattcggcaaatgctttaatttcaaacaatgacaatcgtttaggcaaaaatctttggacagataaaggtgacggcgatcccgttgatatttattgtgcattcaatgagttagatgaagctcgctttgtcgcttcacagattaagcaatggaaagaagatgaaggcgattttaatcaatgtgctgtactttatcggggtaatgcccagtcccgtgttatcgaagaagccctaattcaagccaatatcccttatcgaatttatggcggaatgcggttctttgaacgccaagagatcaaagatgccctagcctatttacgtttaatcgctaaccgccaagatgatgctgcctttgaacgtgtggtcaatacaccgccaagagcaataggggatcgcaccttagatattttgcgtcagcttactcgaactcgccaaatcaccttgtggcaagcaatccaagtggctgttcaagaagaacatctttcggggcgttccgcctcagccttgcttcgctttgtcgaactgattaacgcacttgaacaagaaaccgaagaaatgccactgtttgaacagacggattttgtgattaaaaaatctgggctttatgaaatgtataagcaagaaaaaggggaaaaaggcgaagttcgtattgagaacttagaggagttagtgactgcaacacgccaatttgtaaaaccagatgaagcagaagagatgaccgatctcaccgctttcttaactcacgcctcccttgaagctggcgaaacacaggcttcactacatcaagattatgtggaattaatgacattacattcagccaaaggcttagaatttccacgggtgtttatcgttggggttgaagaagggattttcccaagtggaatgagcttcgacgaaggtcgcttgcaagaagaacgtcgcttggcttatgtcggtattacacgagcgaagaaaaaactcacgatcagctatgccgaaagtcgccgcttgtacggcaaagaagaacgccatttaccgtcacgttttattggcgagctgcctgaagagcatatccgggaagtccgcctgcgtggaagtatcaatcgccctgctacttttgcaaaaccacaagctaatccgaccgctcgtttacaagaagatagtggttggaaaatggggcagaaagttcgccacgagaaatttgggcaaggaacaatcatcaatgtggaaggcagcggtgatcatactcgcctgcaaattgcctttgtacaacaagggattaagtggttaattgccaaagtggcgaagttggaaaagatgtaaaaaaaatccccaaccaaatggctggggattttttactttaatcgtaaattactcagaaactacgttgatagttactactgcatttacttcagcgtgtaagtgtaatttcacttcgtgttcgccgatagtacgtaatgcaccttctggtaaacgaacttctgatttagttactgctacgcctgctgctgatactgcttcagcgatatcacgtgcaccaacagaaccgaataaacgaccgtcatcacctgctttagaagtgattacgattgctgctaagttagcgattgctgctgcacgagcttgtgctgcagataatgcttctgctgctttcgcttctaattctgcacggcgtgcttcaaagtgagcaatgtttgctgcagttgccataactgctttaccttgtgggattaagtagttacgagcaaaacctgctttaacagttacttggtcaccaacggtaccaagttgagcaactttgtctaataaaataacttgcattgtactcttcctctcttattactgatggttgtcagtgtatggaagtaacgcaaggtagcgagcgcgtttgattgcacgagctaattgacgttgatacttcgcacgagtacctgtgatacggcttggaacaattttgccgctttctgaaatatagttctttaatgtagcgatatctttgtaatcgatttcaacaacattttccgctgtgaaacggcagaacttacgacgacggaaataacgtgccattttggcttctcctaatctataaattcaatctgttcggtgtgtaagactaactgatttaaatcattgtagtctttgtgagtatggataaatccttttactcgaacttttccaccgaccttcatttgttgggttattaaactaaattgattgcctgccaaaatcacttggattttgcaccacgcttggcgttctaaattgacttctttttgcactgaacgatgttctaggtaaaaagagtaagttggaatacctatcgggcttaggctttgtttaatcgttgttgcgatagtgccacttaagattaaacagttatcaatagacgaattactcgtctgcatcctcagcttcaacttcttctactaaagcttctggagctttacgctcatcttttgctttaagcattggtgatgcttctgttaccgctgctttagtgtgtaacactaagctacgaagaactgcatcgttgtaacggaagttagtttctaactcatcgattacgttttgtggagcttctacattcattaacacatagtgtgctttgtgaagtttgttgattgggtatgctaattgacgacgaccccaatcttctaagcgatgaacttgaccgcctgcttctttaacagaagcggtataacgctcgatcataccaggtacttgttcgctttggtccgggtgaaccataaaaacgatttcgtagtgacgcattgtcgatccttacgggttaacagcctccaaggttgccagtcaccagcgttggaagcaaggattaaaaacaggtgtgactgaagccgtgcattatacggataaataaaattcgtacaagtaaaagttaatctgcatagcaaaattaggcataaatctatctgcttatggtggtttttagcattagatattaaaaaatttttatccttttttagcatggtaaaaacagaataaaaaactaatttatctaaaatataagaataatgttcttgttatagtgctttaattggcgtttatgagtggttgtatagattttaatactaaaaatagggttgttttattggttttggcgtgttaatttacactctcttttttttcggaaacctttggatttttgacaatgacaactcatactctaagaaataatccacgcaaagtggcgattgcagcaatgatcgggactgcaattgaattttttgactactacatttatgcggcagcagctgtattagtatttaacacccaattctttaacagcgatgaccctgtttcaaatgaattactttccctttctacattagcactagcattcttcgctcgcccaatcggttcggcacttttcggacattttggggacaaaatcggacgtaagaaaacccttgttgcttcattattattaatgggcggttcaacggttactatcggcttattaccaaactatgaaagcattggtatctgggcaactattttgctctgcttatgtcgtatcggacaaggtatcggcttaggtggcgaatggggaggtgcagcattagttgcaacagaaaatgcaccagacggtaaacgtgcttggtacggtacattccctcaattaggtgcgccaatcggcttattcttagcgaactcatcattcttcttagtcagctacattttcggtgctgaagccttagtagaatgggcgtggcgtattccgtttgtttcatctatcgtgcttgttgcagtaggtttatatgtacgtcttagcttacacgaaagccacgttttcagagaagctgaagctcaaggcaaaaaacacgcagcacctgtaagcgaagtatttaaagaccacttaaaaccgttgatcattggtacattcattatgacagcgacctatgtgttgttctacattatgactgcctttgctcaaatttactcaaaaagtgcaccaacgctatcaccagcaggacacccaatgggcctaggtattccagctaacacatttacaggattactcttattaagtgcaattgtatttggtatcttcgttagcctgtcagggatttttgctgacaaaatcggtcgccgtaaatggttaatttatgtgacaacaggtatcggcattttcggtttattaatgcctttcttcttaggaaacggtacaccaatgacagtctttgcgttcttaatcgtaggtatggtctttatgggtatgacattcggcccaatggcggcattattaccagaattattcccaactgaagtacgttactctggcgcatcacttgcctataacttagcatctattgtgggggcaacggttgctgcaacttttgcaattaaaattaatgcagcttatggcttaatcggcgtggggatttaccttgcaattaatgcagttatcacattgattgcactctttgcgtcaaaagaaacgaagaatttggatttgactgaagtgtaaatgctacgaattgtaagttcatttttaagtttgaaaaatagtatccaaaaagtggcttaatctaaaccataacctattcaatttctctatttcaggctgatattccaccattttggcgacacaagcggtgggatcgaagcctgattttgcaaaatagcgagccaagaaaaacgccttttgttccgcagacagcggattgtaatgaaacagcaaggctaattctaaagcaggatcggagatcgccgcatattcccaatcaatcaaaaagagtttttcatcttgttcgactaaatttgcaagatgaatgtcgtgatggcaaatggtttgtttataaggactaatctgtttaaacggaggcgtgaaattgagactgttttgcgttttaagcggtaagttttgccataaaaattgacaacgttcggcaagatttaatcttgttaaattttgcgtagaacgtaccgcttgccaatcaaagcgatgtaagctggctaattggtcagctaatttagcgagtaaaggttggctaaaatggctaggggtttgcccattaatccacgctaataaagcagaggtttcattagcataaatgatcttaggagcgaaaccgagtggctcaatcaaacgcaaaaaagccacttcttgttggtaatcaatgccataatcagtggcttgttgggtctgggaacgtaaaacataacgttcgccattggctaattcgaccaaatggctacaggcggtcagccctgctaattttgtgacagaactgaccgcttgttgttgctgttgttcaagccattgaagtgccattatcgctgaaaacgtaagtaaaaacggtagttttcactttcaggggttggcttgtctaaagcaatctcttggcgttgtttaggttcaaggaacaaatgttgccaagacgatgttgcttcaccctttaaggtttgcgtcacccctgttttgtcgtaccaaaacagtttatagcttaaatgcagagggtgttcacttttattaaacaccacaagttcatccgattttgccacaacgtccgttatctctgcgacattggcttcgatattaacaatcggcgttgtgcctgatggcagatagctaggcggatttgacccacaagcggtcagaaatacgctcaatagtgcaacaagagaaaaagtgtgcttcatcttatttcgccaacattttacctaacggctcaccgccaacaaggtgcatatggatatggaatacttcttgtccgccgtgtttattacagttcatgatcaagcgatagccgtcttccgcaatgccttcttctttggcaattttcgcagcaacggtaaataaacgcccaagtgcttgttcatcttccgcagtaacgtgattaaccgttggaataaatttgtttggaataattaaaatgtgggttttcgcctgtggggcaatatcacggaatgcagtgacaagctcatcttgatacacgattgccgcagggatttctttacggatgattttgctgaaaatagtttcttcgtagttggttagcataatgtttccttatatcagtgttgtaagcggtaggattgtctaacttttttgagcaatttgcaaaaatttctgcaaatttgaccgcttttatttcatttaggggctgtattagattatcaagtatgttagtctataaaaatgaaaataactaattgtaaataatagaaatagtattttctatctcttgtaaagtccaatcattcagattcttcaatgtaatacagggcaagatcacatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatttcgggggcaaacagctggactgaaatcaaactttttggcgaattacatttggattggttgcgaaaatatcgtccttttgagtgtggtattcctgtcgatgatactatcgctcgtgtaataaaacgcattaaatgcttgagacgtttgaggaggtaaatgcggaacgtcgtcgaattgatgagcgttactaccgcaagctgaaagtgagtgattggctgagcaaagcggaggaatggaaggggataaaatcggtgttggaggtgtgtcgcaagcggtcagataatgacaaagaatcgcaagaaaaagtcttttatatcagtagcttggatgttgatattcaaatattgacgaagtgcgtgctaaggcattgggaagtggaaaacaaagcccattgggtgctagatgtggtctataaagaagacgaatgtgctgtgaccgatgaatggggtgcggaaaatctggcaatcttgcgtcgattagcgttgaacttggcacgattacacccgaaaaagcagagtatgaaagggaaattgaccgctgctggttggtcagatgaatttcgagatgagctgttgctcggcgtgtaggttgaaaaatggacaacatatgcggttgccctggaggaaatttcaaaatgtgaacgaaatagtcgcgttatttttcgtgatatggtattggcactacaaagggcacgctataaatgcccgaaaataatcataggaacgccacgcttggcgttcatagttatcgcttgagttaggttgttttgctaataataagaatgttcaccgtgttgatgttcagtcacatctttcacgccaactaattcttctgggaaaagagcaagcaactgtttttcaatgccttcttttaaggtaacatctaccattgaacagccgttacaaccaccgccaaattgcaatactgcatatttatcttcagtgacttcaattaaggttacacgtccgccgtggcttgccagttgtggattgatttgggtctgaatcacatagtctaagcgctcaataaaaggtgcgtcatctgccacttttttcattttggcatttggggcttttaaagtgagctgtgaacccattggatcggtaacatagtcaatttcggcatcttcaaggaaaggaaggctgatttcgtcaataaatgcagaaaattgttcaaatttgatttcagtatccgtttcttctacggcattaacagggcagtaagatacaccacattcagcacttggtgtgccaggattaaccacaaaaatgcggatatttgtgccttcttcttgttgatcaagtaatttgcggaagtggttttgtgcaacgtctgagattgtaatgttcatcattttatccatttatgaaaactaaactgtttgctattttatccctatcctgattttttgactagcatcaaatttattaaaaatgaatttaggaagtgtctgtttttcattcattttgtcagggaataaagagtaaaatttgatgtatttcaaagtttcttaggctaaatgttaaaaaaatgtagtaaaactagcaataaaagtgtgttttcaggtagaataccttgtttatttttatcttggaaaaacaaggtaaagcctaatttgagaacttaatgtagcgaacaaatataagtgggggaatcaacgtttatgtttgcttttagctacgctcaatgtagcgattgcagtttctgcaatcattctttttaacccaactaaaagtagtgcaaacaatatgattacaattaaacaaggcttagatcttcctattgcggggaaacctgagcaagtaatccataacggtaataccgttaatgaagttgctgtgcttggcgaagaatatgtgggtatgcgcccttctatgaaggtgcgtgaaggtgatgtggtgaaaaaaggtcaggttctttttgaagataagaagaatgctggcgtggttttcaccgctcctgcaagcggtacgattgttgcaatcaatcgcggtgagaaacgtgttcttcaatccgttgtgattaaagttgaaggtgatgaacaggtaactttcgagcgttataacgcttctgagttaagttcattaacagctgaccaagtgaagcaaaatttagttaattcgggtttatggactgcgttccgtactcgtccattcagtaaagttcctgcgttagatgcagtgccatcttctattttcgttaatgcgatggatacaaatccattagcgactgatcctgaagtggtattaaatgaacataaacaagattttgttgatggtttaacggtcttaagccgtttatttgatggacaaaaaacaatccatttatgtcgtgcaccagatagtaatatcccaacggctgaagtggctaatgtgaaagtaacttctttctctggtccacacccagcaggtttgagtggtacgcatattcactttatcgatcctgtttctgcgacgaaaagtgtatggtatttgaactatcaagatgtgattgctatcggtaaattatttacgacaggtgagttatacacaggtcgtgtgatctctttagcaggaccacaggtgaaacaacctcgcttagtgcgtacacaacttggtgcaaacctttctcaattaactgcaggtgaactagcagagggtgaaaaccgtgtgatttcaggctctgtgttaagcggtgcgaaagcagttggtgttcacgattatttaggtcgttacgcattacaagtttctgtgattgcagaagggcgtgagcaagagttcttaggtatgattgccccatattcacacaaattctctattactcgtactgtgttaggtgcgtttagcaagaaattgtttaactttaccaccgctgttaatggtagtgagcgtgcaatggtgccaatcggctcttatgagcgtgtcatgccgttagatattttaccaacattgttgttgcgcgatttagcatctggcgatacggattctgctcaagcattaggttgcttagagttagatgaagaagatttagcgttatgtacctttgtctgcccaggtaaaaataactacgcaccaatgttgcgtgcagcgttagataagatcgagaaggaaggttaatcaaatggctttaaaagatcttttccataaaatggaaccggctttccagaaaggtggaaagtatgagaaattctatattctgtttgaagcagcttatacgattttctatacaccgggtacagtaactcaaaaagatgctcacgtacgtgacgcaattgactccaagcgtatgatgttaatcgtatggttagcattgttcccagctatgttctacggtatgtataacgtgggtgcgcaatcaatccttgcattaggcgtcggtgactttactcaaaatgtagctcaaaacgtggcaaatgactggcactttgccttagcaaatgcattcggtgtgttatcacaagatgctggcgtatttggcaaaatgttaatcggtgcgatcttcttcctaccaatctacttaaccatttttgcagtaggtggtttctgggaagtgttattcgcaatggtgcgtaaacatgaaatcaatgaaggtttcttcgttacttctatccttttagcattaatcgttccaccaacattaccattatggcaagcagcgttagcaacaacctttggtgttgtggttgcaaaagaagtctttggtggtgtaggtaaaaactttatgaacccagcgttagcaggtcgtgcgttcttattcttcgcatacccagcacaaatttcgggtgatttagtttggactgcagcagatggcttctcaggtgcaacagcactttctcaatgggcagtcagcggccaagctgcacttaaacacgttgcaacgggtgaaaccattacttggatggatgcattcttagggaatatcccaggctctatcggtgaagtatcaactgtcgcattaatgatgggtgctgctattattgtatttgctcgcattgcatcttggcgaattatcgcaggtgtaatgattggtatggctgcaactgcaaccctcttcaatatgattggttcagatacaaacccattatttgcgatgccgtggcattggcacttagtgttaggtggttttgcaatcggtatgttctttatggctaccgacccagtatcagcagcatttactaataaaggtaaatggtggtacggtatcttaattggagtaatgtgtgtgttgattcgtgtagcaaacccagcatacccagaaggtatgatgttagcgatcttatttgctaacttgtttgctccaatcttcgactacttcgtggttcaggctaacatcaaacgtaggaaggcacgcaatggctaagtttaataaagatagcattggcggaacacttaccgtcgtgattttattaagtttaatctgttctcttatcgtggcaggttctgcggtgttgttaaaatcggcacaggaagaacaaaaagcccttgataaacagaaaaacattttaagtgttgctggtttattacctgaaggcacgaagaaaagcgaaattaaagatatttatgtgaaaaatatcgaatctaaaatcgttgatcttgcgacaggtgattatgttgaaggtgtagcgaattttgatgcaaaagcagctgcaaaagatccagctcaaagtatcgctatcaatccagcagacgataaagcaggtattagagttcgtgcaaaatatgcggaaatttaccttgtaaaagatgcaaacggacaagtaaatcaaatcgtgcttccattctacggaacaggtttatggtctgtaatgtatggctttgtctctgttgagccagatggcaatacaatcaaaggtatcacttactacgaaaacggtgaaacaccaggacttggtggtgaaattgaaaacaaacgttggcaacaaaatttcgtgggcaaaaaattacaaaatgctcagggtgaatccgcaattcgtattgcaaaaggtgcttcagctgataaagatcacggcattgatggcttatcaggtgcaacactcacctctaacggtgttgatggttcattcaaatactggtttggtgcgaacggctttggtccatatttagcgaaattaaaagcggggactaactaatggcaagcaataaacttaaagatctcttgttatcacctgttgtgaataacaacccgattgcattgcaaattctaggtatctgttctgcacttgcggtaacaacaaaactagaaactgcggtggtaatgggtattgcagtaagctttgtaataggcttttcaagtatgttcattgcgatgattcgtaactatatcccaaatagtattcgtatcattgtacaaatggcgattatcgcatcgcttgtaattctcgtggatcagttattgcgtgcttatgcttacgatctttctaaacagctctcggtatttgttggtttaattattactaactgtatcgtaatgggacgtgcggaagcctttgcaatgaaatctggcccagtagaaagttttgttgatggtatcggtaacggtttaggctacggtgcaatccttgtgattgttgccttcattcgtgagttaatcggttcaggtaaactctttggtatgacggtattccaaactgttcaagatggcggttggtatcaagcaaatggtttattcctacttgcaccaagtgcgttcttcatcatcggcttcttaatttggggcttaagaacttggaaaccagagcaagtggagaaataagatggaacattatttaagtctatttgttaagtccatatttattgaaaatatggcactttctttcttccttggtatgtgtacattccttgcggtatctaagaaagtttcaacagcatttggtttaggtattgcggtaatcgttgtactaggtattgcagttccagctaaccaaattgtttacgagaacatcttaaaagatggtgcattagtggaaggggttgatttaactttccttaactttatcacctttatcggtgttatagctgcactagtgcaaattctcgaaatgattttggacaagtttttccctgcactgtatagtgcattaggtatcttcttaccacttattaccgtaaactgtgcgatcttcggtgctgtatcatttatggttcaacgcgaatataacttcgctgaatctgtggtatatggtatcggtgcaggtacaggctggatgttggcaattgtggcattagcaggtatcacagagaaaatgaaatactctgatgtaccagcaggattaaaaggtttaggtattacctttatttctgcaggcttaatggcacttggctttatgtctttctcaggcattaaattataaggagcgtatcgaatggataattttattttcggtatcgtggtatttactgcccttgtattaatgcttgcagtacttatccttgtagctaaatcaaaattagtggactcaggtgacatcacgatttctatcaatgatgatccagaaaaagcaattaccttgccagctggcggtaaattacttggtgctttagcaagtaaaggtatcttcgtttcatccgcgtgtggcggtggtggctcttgtggtcagtgtatcgttaaagtaaaaagcggtggtggcgagattcttccaactgagctttcacacatcacaaaacgtgaagcaaaagaaggttatcgtctagcgtgtcaagttaatgtgaaaagcagtatggaagtggagcttccagaagagatctttggtgtgaaaaaatgggaatgtactgttatctctaatgataacaaagcaaccttcatcaaagagcttaaacttcaaattccagaaggcgaagaagtaccattccgtgcaggtggctatattcagatcgaagcacctgctcacactgtgagatatgaagattacaaagcgttaatcgacgaagaatatcacgaagactggaacaaatttaacctatggcgttatgtgtctaaagtggacgagccaattatccgtgcgtactcaatggcttcatacccagaagagaaaggcattattatgcttaacgtgcgtattgcaactccgccaccaaataacccagatgtaccgccaggtcaaatgtcttcatatatttggtcactcaaaccaggtgataaagtcacaatttctggcccatttggtgagttcttcgctaaagatactgatgcagaaatggtcttcatcggtggtggtgcaggtatggccccaatgcgttcacacatttttgaccagttaaaacgtctgaagtctaaacgtaaaatgaccttctggtatggtgctcgttctaaacgtgaaatgttctatgtagaagatttcgacagcttacaagcagagaacgacaacttcaaatggtatgtggcgctttctgatccacaaccaggcgataactgggatggttacacaggctttattcacaacgtgctttatgaaaactacttaaaagatcacgaagcaccagaagattgtgaatactatatgtgtggtccaccaattatgaatgcatctgtgatcaagatgttaaaagatcttggtgtagaagatgaaaacatcttattagatgatttcggtggctaatcagctataatcaagcggtcggatttgcaaaaaaatatgcggatctgaccgcttaagatttataggaaaataacaaaagatggaaacattagatatttcggcacttgaaaaagcctttgtttctctgcaaaaaacgattactcacttagataatcaagaatggtttaatgctcaagatccaattatccaagatacacttattgcaggagtaattcaaaaattcgagtttgtttatgaattatcaattaaaatgatgaagcgtcagctgaaaagtattgcttctaatgataccgatatagacagcacagaatttagagatattttacgtctatcagctcaatttggtttaattgataatcctgaagaatggttagatttccgtaaaatgcgaaatattacatcacatacttatgatgaaaataaggctctgcaagtatatcaaggcattagccatttcctagcgagtagccattatcttctctctcaacttcaaaaacgtagccaatgatagatttgaccgaacaacagttacaccttgttcaacgcattttagcgacacatttgccgaatgttcccgtatgggtatttggctcaagaattaaaggaacggcaaagcgattttccgatcttgaccttgcattgattaccgatacccccttaacaattcaccaacaagctcagcttgaactggctttttcagactcagatttgccatttaaagtagatttaattgactgggcaagttgtagtgacagcttcaaacaaattattttacagaagtatgaggttttgccttgtctttagcgattattctggtctataaagaaaaatggaaaagctgaaaatagcattaaaagaaatgcggtaacagtcgcatcttcagtacggtaactgcctaattgttggtaaagcaaataaggtaaggtgctaaagtcagggctaccaaaaaaggcaatcacggaaaaattgcctaaacttgccgacattgacagggcaaaagcattgataagcggtcggataagataatttttttccacaatccaccaacggcgaagccctgttaatcccaaactacgagccaatttatcgtgagaaaccaatgcttcccacattgctgaaaacaacaagcgatagatgtaaggcagtaacatcaaaccgttacaaattcccactaacaatagcagttgccaagtggttaattgcacattgatcagcagtaaaaatagcccaacggctaacataaatatcggtaaaatcaggggataagtactcacacctgcgagaatgctttgcttgattttctgtttatgataagcaagctggcgagtttcaagggcgagcagataagcaatgcctaccacaaagcaagatgcgataagacttaataacagcgaatagcttgccgattgccaaagtgttggcgaaaagagccgttgccaaaagtttgatactgaaatggcggtccaaactacatttgcaagcggtaataaaatggtaaaaattgccccgaacagcaccgcttgtagtagccatttttccttacctttaggctgtgccgtccagatgtcaatcgatacagactgtgttttcactcgctgaaaattaaagcgtgtcacccaatccattatcagttgtaagccaatccctacaaggatttgcaccataattaacatcaccgctttcgcaaaatcaaactcaaaagtcaccgcttggtaaatcgccacttcaagcgtactgtatttaggtcccccccctaacattaatacaattgggaagctggtaaaacagagcaggaaaaccgtcgcataggcatagggcaaaatgccttttaatatcggcaattcaacaatcctaaaatagtgccacccagacagattgagctggttcgccagttggtgctgatgtgttggaataagatgtagcccttcaaagcaatactttgcgacaaggggaatgttcaaaaacagatgagctaacacaatcccttgtaaaccgtacaaggaaaaatcccacgacaatcccaccgcttgaacgagatgggctatccaacctgaatttccccaaaccccgattaatgcaaaaatcaccactaacgaaggcagagcccacgcaaaggaaatcagcttatagagcaaggttttgctccgaaaacgtaggtagaaaaagctacgagccaacaaaacaccaaacagcaaagataaactcgccgacagcgttgcttgcaaggtgctgtattttaaaatttgccacgtttcttgccacgaccaaaaggtttcatcggcactatgttcaaataatgcccagaaactgaacgtatagagtgagagcaagccaacatagcttgcccaagcggaaaattgggtgagttttcgggacatttatatctcgttgataatattctgctgtcatataagtaggcaggctattttaacatgaataaaatttttcttaactagaagataatcaatcagttagaaaatataagagagaaagattgcctaacaaagctcatttaatcaccattcaatttttgcaatttgatttttttcaaacaaattgcagaatcctctagtaaaacattcattctttttatacatttcacatacatcttttatttatatctatcttattgttttaataagaaaaattatcatttgcagtgagttatgtgtgaggaggctcgcgtgaaaaaagtcagtaaaatgttaaaaaacagccttgttgcgacaatggctatgttggggtgtttccaagctgcgtgggcaggggaagccaaagagtttgaaggtccaaaacctgatgtgaaaattgaatcagctaaccataaatttgctgaactttatcctttacagtaccaatcttgggctgcaacagccgaatctaaagaagtaacaagtgctttagaagaagatcctcgtttagtggttttgtggacaggttatgcgttctcaaaagattacaataaacctcgtggtcacttctatgcggttactgatgtgcgtaatattttgcgtactggtgcgccaatggacgaaaattctggccctcagcctatggcgtgctgggcgtgtaaaagtccagatgtgccacgtatgatcgcagaaaaaggcgaagttggttattttgatgcaaaatgggcaaaatatggttcagaaatcgtaaatcctattggttgtgcggactgtcacgataccacttcacaagaatttaaagatggcaaagcggcactgcgtgttgctcgcccacacgttttgcgtgcgttagaagttatcggttggaaattcgatacactggataaacacggaaaacgtgcagcagtatgttctaactgtcacgttgaatactattttgcaggcaaagaaaaagcggtgacattcccttgggataaaggtgtagatgttgatagcattgaaaaatactttgatgaaatcaaatttactgactgggttcacggcttatcaaaagcaccaatgctaaaagcacaacacccagacttcgaaacttgggcgttaggcacacacggtaaaaatggcgtaacctgtattgactgccatatgccaaaagtggaaaccaaagatggtaaagtgtataccgatcacaaaatcggcaatccatttgataactttgagcatacttgtaaaacctgtcacgaacaaagcaaagagagcttacaagcacgtgtgaaagagcataaaaaacagatcaaagacgtaatgatccgtttggaagatcagcttgttaaagcacactttgaagcgaaaagagcttgggaagcgggtgcaactgaagaagaaatgaaagatgcattgcaagcaattcgccacgcacaatggcgttgggactactcagctgcaggacacggcggtcatatgcacgcacctgatgtgattcttcacgttatcggaacaggcttagatcgtgcagcagatgctcgtactaaacttgcagttatcttaacgaaacacggcgtacaaactccgattgagttccctgatatttcaacgaaagcgaaagcacaaaaagttgtaggtatcgactttgataaagagaaagcagcgaaagaagaattcttacgcaccgtagtaccacaatgggaaaaagaagcgaaagagaaaggcttattacctgcggacgcaaaataatttgctaagtcgaggctactatgaaacatattttctcaatgattaagctacaagcggttgcattactgagtttctttgcaatatcttctactgtgttggcagaaatgccagcacagccacaaccaatttggagcaatccgttggacaatgtagatggtgcaactattactaaagactctcgtcgtgatccgaatacttattgtgtgaattgtcacggacatttatctaccttcaaacacacaggtaagcactttcaaaaagacacggttagtccgaataacggcaaaccgcttaactgtgtaagttgtcacggcaatatttctgaaaatcatcgtaagggtgtgaaagacgtaatgcgttttaatgctcacggtaaggctaaaaatccagccttggagcgttcagtcgaagagcaaaatcaagtctgttttgcttgccatagccctgacaaattgcgtgagaaattctgggcgcacgacactcacgctaataaaattgcgtgtgtaaactgccacaaactacacccagaaaaagagccaatgaaaggcattgagtctaaacagcgtgtaaaactctgcgtggattgtcacacagaagtacacaaaggtacgtttaaaaaagcggaagctaaggatcaaaaatgagttgttcccgtcgagattttatctcaggggcgggagcagtgattgccgtggcaggcacaacggggcttgccacaagtcagctctcccttgcgactgagaaagaaagtaaaaccattcgctatgcgatgttgcacgatgaacaagcctgtatcggttgtactgcttgcatggacgcttgtcgtgaaacaaacaaagtgccagaaggggtatcccgtttagaaattattcgtagccaaccttatggcgaatttccaaacgtaaaatatgaatttttccgtcaatcttgccaacattgtagcaatgcgccttgtgtgagcgtttgcccaacaggtgcgtctttcattgataaagcaacaggcattgttgatgttaatccagatctctgtgttggttgtgcttattgcattgcggtctgtccatatcgtgttcgctatattgagccagtgaagaaaactgccgataaatgtaacttctgtcgagatacaaatcttgcacaaggtaaacagcctgcttgtgtagaaagctgtccaaccaaagcattaacattcggcgacttaaacgatccgaatagcgatatttctcgtttaatcaaagaaaaaccaacttatcgcacaaaaatggaattaggcacagaaccaaatctttaccatattaagaaaggggaggcaaaataatgaacgactatgttccattccaaaccccaaatcttgtatgggattcgaccattgcgatctatctctttttacttgggatatccgcaggttcaactttattagccgtgctatataagcgtaaagcgagtttagctgatccaagccagagttggatgattcgcacaatggcaataatgtcaccgcttgcaacaatcatcggtttaaccttattgattttccacttggctcgtccgtggacattctggtatttgatgtttaactaccagtttgattcggtaatgtcgatgggggtaatgctattccaagtctttatggcggtattagtcgtttggctggcaatcatcttcaaaaactggctaagcggttttggttttattccgaaatttgcctttggtttgattgatattgcggcaaaatttacctcgttgattgaaatcctgttgatcttactatcccttgcacttggggcttatacggggttcttattatctgaattaatcagttacccaatgttaaataaccctgtcttgccagtcttattcttggcttcaggaacttcatctggtattgtagcacttcttgttgtaatcttggtggttggcaaagtcgcaacggatagtcacgaagtacatttcttgcacaagtttgaaaaaccagttgcccttattgaaatgttacttttagcaggcttctttgcttacctttatgctaaaggtggacaaagtgctgtggcagcagataacgctttagccttctcaggctactggggtaaaatgttctgggtaggcgttgtggctatcggtttagtcattccaatgttacttaacattgtttcaccagctaatgtcaaacaccaaaaaggctttatcctttttcttgcggtattaggtttaatcggtgttctctgtttacgttactttgttctttatgccgggcaaatgacgattgcttaacccctcacaagcgggcagagcttgcaaatttatcgcaaaatctgctcgcttgcttttttcaatatcgataaaatgttaatacgagtttctatccaaaaggagctaatatgaacagaccagtcaaaaatgaaatgtttattgtaattgctaatggtttatggcgtttattagggaatatcgtcaaaacgttaagctatacgtttcacgccttatttccgaaaaagcgttttaccattccagaatttagtccagctaaaagcgtatcagctaaatcaacgaaaattactaaggtcatttggcagactaattacagcaacaaagtaaccttaccagtgtattgtaattatttggttaatcgtttgttgtcacgagattatgactaccgttatgttagcactgaagagcgggcagagtatatcaaagctaatgcagatgagcgtacttttaatgcgtatagtaaacttacggatggggctgcgcaggcagatttctggcgtattttcaccttatataatgaaggtggcatctatatggatattgatgggcatttagtttggaatctcgcttcaattattggtgaagatgatagtgaggttgtgatcactcgccgagacaaatacaccaatttctttttagccagtgaaaagggaaatgcgtttttgaaagaaacgttagagattattgtcgataatattgagcaacgtcggattgatggtggcgtattttctttaactgggccagtcaccttaaatatggcattggaaggaaaaacggttaatcgtcgccgagataaaatcacttgcgcgcaggggacttttactaacgaatattttcagtatatggataaaaagcgtagtaaatggaatcacgctaaaaatgaagatttgttgaagtaatctgatattaagaggcatagtaaacaaaagttactatgccatattggtgtcttaattgattattgggtgtaatagacaaaagaaatatagatatatatctaaagacattatggggaatcaaacaattcctttgcttttaatagtaacagtagggcagttaaatctccaaagtttactacgaatgccgattgttcttgtactttgggtttggcatgtagtgcaacgcctaaactggcatgtttaagcatcagtagatcattggctccatctcctactgcaatccattgcacttgtggaataccaaacttgtgagctagagccattaacgtatctgctttacattgagcatctactactttgccaagtatttgacctgttagtttgccatcaataacttcaagcctatttgacacagaataatctagatcaaaagactgtctgaggtagtctgcaaaatagtcaaatcctcctgaagcaatagctatcttccagccatattgtttcagacttttaactaataattcaaaaccatccataagtggtaactgttcacgaacttgttgtaagatactttctggtgcattttcaagtgctgcaacacgctgacgtaaactttcttcaaaatcaagttctccacgcatagctcttgctgtaatagatgaaacaatctctccttttcctgctaatttagcaatctcatcaatacactcaattttaatcgcagtagaatccatatccattaaaagtaaaccttcttttttaatgcaaggaagaatatctaacctactaaaatcagcttgtatggtttgagccttctctcgtagagaatctgtcaaatctcctctaaaaaaagcaacatggtaatccaaatactccacttgttttacaaaaatagtagaacttatgtgagtgaagtgggcaatctgttcagctgtaagctgcttactgtaaataaaaaagatatgtgacatgattctttcaaacctttatagtgagttttactaactttagcaaaattacgtgttagaatcatcttctaattttatggggacaattatgtatatttctcgtgaacaactaataaagagtagcattattgctgtgatcatagcaatttgtttaatgattgtgtggataatactgactggtataaaccatttcaaagtaggttcacagctggctgggattaaccaagtaacaaatctttctcatttacttgtacgacaacaggcaaaattgttttccttgatgttagtaaaaaacgcaaaaaatgatgaattagttgaagcattagatgtttttgctaaagaagcgtttgtcattgatgctaatttgtattcgccatcaggaaatttagttgcacatagtagcaatgcgattgaatttaacccgagagtaaacgacaagatacaacaagagccggtacttacccaacaaattgtagagcctatttttgcacaggatgacttaattgggtttttacgagtaacttttgactctcaatatgggcaaacaacacaacataaagtaaatgaattatttcatttgctttatggtgagttgattattttatttatgtctggagggctatttgttagttgtttctattattttttacagctaaatacaacaaaaacagtttcgtcaaactttatacctattgaattaaaacgtcaaactcaacgttttcactctcgaagaagagcttttcgccgtaaatgattgtaattcaggtaagggagagtataatacctcgccttttgccaatatggcatatttacaatgacacaacttaaatttaatttgaagaggaataaatggctaaagaagattgcattgaaatgcaaggtacaattttagaaaccttacctaatactatgtttcgagtagaactagaaaatgggcatgttgtaacagcccatatttcaggaaaaatgcgtaaaaactatattcggattctaactggagataaagtcaccgttgaaatgaccccatacgatttaagtaaggggcgaattattttccgtgcaagataattgaggtatacataaaaatggaagcgtctagctcccatttttatggtcagctctcggttattttttagtaaagtcaggtcaatcttttgagcaaacgtcgcttaactcagaatcaacaacgtcggattcaaactaaccatcacaaaaagatcaacaaagctgaatttgaatggcaagatgaaatgttgggggaagtccagcaaggtcttgtggttactcgccacgctaaacacgcagatgtagaaaccgcaagtggtgagattttccgttgtaatttacgtcgaacgctgaaaaatgtggtggtaggcgatgtagtgtcgtggcgtttgggaagtgagcaattgcaagggattagcggtgtgattgaagctgttcacccacgccaaaatgagctaactcgtcctgactattacgacggtattaaagtaatggcgtcaaatatcgatcaaattatcattgtgtccgctgtgttgccacagctttcactgaatattatcgaccgctatttagtgatttgtgagaatgccagcattcctgccttaattgtgttgaataaaattgatttattgagtgaacaagagcgaaaagaagtgcaacaacagctggcgatctatgaaaagattggctaccagacactctgtttatccgcagacacaggcgagaatatgcaggcgttgaatgcttatttagcgaaaggtacatctattttcgtcgggcagtcaggtgttggaaaatcgagcctaatcaatcagttattacccgatgtaaatgcccaaacgggggcggtcagcgatatttcaggcttagggcaacataccacaacggcttcacgtttataccacttatctcaaggtggaaatttaatcgactcgccggggattcgcgaatttggcttatggcatttagaagccgagcagattacacaaggttatcgggattttgcttcggtattaggtacttgcaaattccgtgattgtaaacataaagatgacccaggctgtgcattaaaagaagcagtagagcaggggaaaatcgatccgatacgttttgataactatcacaggctcttagaaagtcgccaagaaagcaaaagtcagcggcattttaggaaagagtaataaaatcaacgggttgctagataaaaatagcaaccctttctcatttgtaatacttattgattctcatatttatcagcttgttgattatcatctagctgagttattgagaatcatttttatttgttgacaggttaaattttatctataaaatgctgcctgaaaaccccataatttatataaggagactaacgatgaaaaaattagcagcactacttagtatgctttttttggtaagtaatccacttgctgcccagcagtttaaagtggtcaccacattcactgtgattcaagacattgctcaaaatgtcgcaggggataaggctgtggtcgagtcgatcaccaaaccaggtgcggaaatccacgattatcaaccaacgccacaggatattgtaaaagcacaatctgcggatttggtgttgtggaacggtatgaaccttgaaagctggtttgagcgtttctttgctcaagtgaaagataaacctgcggttgtagtaacggaaggcattgagccgatttcaatctatgaagggccttacaaagataaaccaaacccacacgcttggatgtccacgaaaaatgcgttgatttatattgaaaacattcgccaagccttggtgaaatacgatccggcaaatgcagaagcctataatgcgaatgcaaaggcctatgccgataagatcgttgccttagatcagccgttgcgtgagcgtttggcaaaagtgcctgaagcacaacgttggttagtgacaagcgaaggggcgtttagctatcttgctagagattatggcttcaaagagttatatctttgggcgattaaccaagatgaacaaggcacgccaaaacagatccgcaaagtgatcgaccaagtgcgtaaacatcaaattccagtggtatttagcgaaagtaccatttcagataaaccagctaaacaagtggcaaaagagagtaaagcacgctatggcggtgtgttatatgtggactctctctcaacaaaagatggcaaagtaccaacctatattgatttactcaatgtgacggtaagtacaattgttgctggatttgaaaaataaaacgatttgggcgaactgctttggttcgccctgcatttacaaaataggattacctaacaaatatgaacattcccttgagttctctttctgtttccgatgtcaccgttcgttatagcaacggacacacggcaattcacgatgttacttttcgccttgacggtggcacaatctgtgcattacttggggtgaacggcagtggcaaatcaaccttatttaaaagcattatgggcttagtccagccaaagggaaatattgagctatgcggactgcctgtcaatcaagccttaaaacgcaatcttgttgcttatgtgccacaaagtgaagaagtggactggcaatttcccgtatccgtttatgatgtggtaatgatggggcgttatggctatatgaattttctgcgtatcccttctgctgtggataagcaaaaagttgctgaagcaatggagcgggtcaatattgctcatcttgcggatcgtcaaatcggtgagctttcagggggacagaaaaaacgagtatttttggctcgttcgcttgcacaagagagcaaaattatcttacttgacgaacctttcactggcgtggacgtaaataccgaaaatgcgatcatcgatctactcaaacagcttcgggatagcggtcacttaatccttgtttctacccataatttagccgccgtaccaagtttttgcgatcaagcggtaatgattaatcgcacagtgttagcaacaggatctatcgaaacgacattcacccccgaaaatcttggacgagtatttggcggtgtcttgcgttatcagcagttactcggagaccataaggaataatcaatgcttgagttactgctagaacctttttcctacgattatatgtttaaagcgattgtagtaagcggtgcaatcggggctgtttgtgcttttttgtctgcctatttaatgctcaaaggctggtcgctgattggagatgccttatcgcacgccgtcgtccctggtgttgcattagcttatgccttgtccttaccttatgctgtcggggctttcttttcgggatttcttgccactattgctatcttagcggttaaatccgtcacaaaattgcgagaagatgcggtaattggttttatttttaccaccttttttgccttaggtttattgattatttcaatcaatccaacgtccgttaatgtgcaatccatcattctcggtaatatcttaggtattgccgatgaagatatgctacaagtggtgattattttatcggtgtcactcttttttctagtgatttactggaaagatttattgcttgtcttttttgatgaaattcaagctaaagccgtaggcatttcgccgatgcgacttaaagtgctgttttttagcctactcagtgcttgtatcgttgcagcattacaaagtgtcggtgcaattttagtgatcgcaatggttgtcaccccaggggcaacggcgtatttattaacggataaattcggcaaattgttgattatcgcaatttcactgggcggttttagtggattttttggtgcttatttaagctattttgctgatggggcaacgggcggatttattgtcacactacaaactctactgtttttactggcgtttttcttcgctcctaaatatggtttactctcacgcaaatttgcaaaaaatccagcaaaactgaccgcttgtcaagggggagaataatggacgcactctatcaatggtttgctgaaccgctagcttttccttttatacaacaagctttgctcattggtgttgtggttgccctaatctgtgccgtgttgtcctgctatttagtgctcaaaggttggtcgctaatgggcgatgccatctcacacgccgtattaccagggattgtgattgcctatctgcttgccattccattagcaatcggggcttttgtttcgggcattttctgtgccgttgcagtgggctatctcaaagaaaatagtcgcattaaagaagatacggtaatggggatcgtcttttcgggaatgtttgcgttaggtttggtgatgtttgccaaagtcgaaaccgatcaacatctaatgcacatcttatttggcgatctgcttgggattaccgacaatgaattttaccaaactctcgccatttccttagtggtattattcgttatcttagtaaaacgccgagatttcctactatactgcttcgatgccagccacgctcgcaccgttggctttaatatcaaagtgttacattacagcttactggtgctattggcattagtgattattagtgcaatgcaagtggttggcgtgattttagtggtggcaatgctgattaccccaggtatcacaggctacacgcttgccaaacgctttgaccgaatgttgctaatcgccatcttgactgcagtaaatagtgctttctggggcgtgtttttaagtttccatttcgatgtcgccacaggaccttgtattgtgttgttgcaagcggtgggatttttgggggcgttaggaatcaataaatttaaagtaataggcaaaaaaatttattaaagttatatttttctttaatctatgttaagtccctagatagcaaatcatctagggactttatctttattaattaactaattaaccacttctcaactaattctggtgttgtttctttgtgtcgccacatactgcctaattctggctcagggaatttggtatggttatagccaacaaattcacggaaatcaaatacggcgtgtggataatcatttaacagcaaaaatgcctcgtagccatcttctgaccagcagatctgaaaacggcgaggctcttttagggtttcgggtttgacatcgctgacacgatagacaaataagctatcgaccacaggttgcgcttcttgatgtaaatccattgcatagaaataacctgtttcgccatcatcttcaaacattaccactaaatgttcgtgtttaatggaatgtgtgccgttgcgatagggcgtgccgagcgtgatatgatcgtttaggactgaatataacataaggtttcctcttttaattttggcgacattttaacatattctagctgaggaatgcttgggctatctgctgggcgttagaaagtcttttcaaaagcaagagtaatattatgcattttataggaataaagcgtatccaaattgcttttctgtttccgccattccaaattcaatttaggtgtaatgccccataaatgccaatctcgtttccaaacttgtgcgaaaactgaataaatctgatcttggcgagttttgccgagtggcaagatgccgcccaatatcgcttgatctttaaattggcgatgcgtaaaagagaaatttaatttagttgaaatcccaaaagcgtattcttgcaaccaacctaaacgtaaattctgaatatctgagctgtattgttgctcttgtaagcgttgctgagaaaaggcggcactgacataaaaaaatctgttcggggtttcgataccaaattaacgttgttgatgccgtccgaatatgcccggcttgaggattatctttgaaaaaacggcgtttttcatattcaagtacggtttgattttgccaattttgtgaaagccaaaaactgtaactgatttccgctccattggaccaatgaaacgaatctccaccataccaacgtttttcactttatcaaactgaactcttgcagcactgtcttgccgatccgcaaacagcacttttgccaattccattctgatggagttgagttctggtcgttcgctcaatatttttcgataaatacgaatagcaacgccatagttctgctgtaaaactgatagtttggcttctgcataagactttaatgtcaaatcttgctgaggctgttgctgatattggtaaagtaaagattggatttgaccgctattattttggtaaatagcttgtttcaattgctcttcaagtgttgttgcggaagcaaaaacaatattagaacaacataaggcgagtaaaaagaaagaacgcataagaatggtaaaagttatattcaaacctagcacgcaaatgcgaactaggtttaactgctcaaagaattagtaacgaataccaccgaatgaagtatcgtagctgttatcgccactgaaagttgcaatacctgccgcttcttttgcaccattgccaaataagccaccttcataagtaccttctcgtaatagagtggttgctttgccgctgaaagtggtaccgtttaattgggttttgtgcaaggtaatatcttgcgcacgtccatcggttaataggctaaattcaactttgtcatctactgttttttgatcgaaatcatggcacagcttcctgcagaaatgacagataaattaattgggcaacgtattcagcaaaagagaaaggaatttggttattcggcagaaaagttgtcggagtgtatcaatttatctcagcaacaactttcacgctatgaacgtggtgcaagcaaaatcaacgttaatcacttgattgatatcgctattttctttaaaacacctattaattggtttttccaagattgtattccagcagaatttactgaaaaggaattaaaagagatagaaataaaccaaaatagaaaataaacattagcaacaattttgtctactatgctttttaacttaagaaatataaaaggctcttataaattttttccaatattacataatccactgattaccagtggattatgaattgaattacacggtatatttaaaactcttttaatagatttacacttataatttcaagcagccttgatgtttccaaacaattctctcgccctttaataaagaaacgagaagtcatcgctttttcaccattattgaggaaaatctcaaccacagaacggtcaaagaagatctcgacattctctaatttttcgacttcgcaatagcgttgttcaccaaattgcttcattagatctgtttgatctgttgctgaacgatctagggtaactcgcccattttcataacggaaagtcagattttgcccctgctcgttatcaaagaaacggattacaagcggttgattttccacattaaattgcaaatatgcgttgtctaggttttctacttccgtaatcccgttcacactcaacgacactttatcctgcaattgtgcataaatctctttaactggctgttggaaaattttaccctgtttaacggaaagctgacgaggcattgtcagcatagagtgccatttatatttatccgttggatacattaaatctggcaagccaacccagccgtataaaatcccttctgcattctggacagtctgcggtgcatagaaatcaaagccataatctagctcttcaatatgttctgctgtcagcgttgagccagcgaattgacctaacgcataagtggcgtggtaattattttggaaacgtgtcgcttcacgcaatttaccctgtggcgaccagacgaacagatctttatccgccaatttgaacaaatcggggcattcccacataaatacgttgctattatcaaaatcattaatcgcaatttcagagagtaaacgtggggtagcttctaggttatccatttcatagagcaagcctgtgcctgttaggttttcacgttgagcgcctaatacaaaacggattttgccttctgcggtaacaaaaggttttggatcacgaacgtgttccgtatagccttgtggtgcttgatcgataatacaacgcttttcaagcaatttgcccgatttatcaaaaatagcaatattttgatgtggcacacgctgattatcgctcgctcgacgcgtattgcccgtatagaacgcaacaatcttatcttgccataaaatcgccccacccgaataacaaccgtgggattcaaacatctcatcaggaataagcggatcagcttcagtaaatgtttggaaatcctttgtcatcagatgtttccaatgtttcattccgtgcaacgcatcgtaaggaaaccattgataaaaaatatgatatttttcaccgtcaaagattaagccatttggatcgttaagcaatcctgttggcggtgcaagatgataggtcggacggaaatcctgatccagttcaaccgcttgacgaactgcatcaagttcaccaacttcttgagcgtgcaggcttttgtatttaccttgattgaaaatgtgcatagtattttcctcctgtgagggtttagttccttgtacaacctgataacatcgtctacattcacccccaaagatgttatttacaacattcttttggaaataaagacagataaatgaagcaaatgccatatcacacacagaggatttgcgatgcccaagaaatgaaaatctgtcactcagtgacatgtacaactctgtaaatgtaagcgatgtatggagtatacactgataagtgtgcagcttttttacagctaatgcaaccaactttttcacacacaaagtgaagaagagaaaaatagatgttgtacaagaattaagaatagatatgctgttttttctatttttgtatagattccacctctggggtattggctcagttctaccaagtggcaattaattcgggcgttgcaccgcttgtgatctttatgggcgttggggcaatgacggattttgggcctttactcgctaacccgaaaacattgctcttgggtgcagcagctcaatttggtatctttgcaacggtattaggagcggtgggtttaaactggttgggtgtgattgacttcactttaccacaagcagctgctatcgggattattggtggggcagacggtccaacggcaatttatcttgccagtaagctcgcccctgagttgttgggagctattgcggtagcagcttattcttatatggcgttagtgccattaattcagcctccgattatgcgtgccttaacgacagagcaagaacgtaaaattaagatggtgcagttacgaaatgttagcacacgtgagaaagtactgtttccgattgtgttgttgattttggttgcattattgcttcctgacgctgctccgttgttaggtatgttctgttttggtaacttaatgcgagtgagtggcgtagtcgaaagattaagcgatgttgctcaaaatgcgttaatcaatacggtcacgattttccttggcttatctgttggttctaaattaattgccgataaatttctacaaccacaaaccttaggcattttagcattagggattatcgcctttggtattggtaccgcaagcggtgtgattatggcaaaaataatgaaccgttttagcaagaccccgattaatccgttgattggttcagctggcgtatcggcagtgcctatggctgctcgtgtatcaaataaattgggacttgaggcagataaacagaacttcctattaatgcacgcaatgggtccaaacgttgctggggtaataggttcagcgattgccgctggggtgatgttgaaatatattgcggtgttgcagtaaattatttttcgttgttggggtattcatttaataccccaattttttattcatttttacaaaaaatccctcaaattttaccacttgtagtagaatagcgtttatttaaatctattgaggatatttatggattaccctatttgccctgcttgtaaaagcgaaaatacttaccacgattcaattcaatttgtttgccctgattgcggaaacgaatggactggtaatgaagttgaagtcgatgaagatcaattgatcgtaaaggatagcaatggaaacttacttgctgacggtgacgatgttatcttaattaaagacctaaaattgaaaggatcctcagaagtactgaaaaaaggaactaaatataaagggattcgtctagtcgctggtgatcacaatgtagattgtggaaaacttttattgaaatcagaatttttgaaaagagcttagattttaacttagtttataccgtaataggataactatagtaatatggaaagaaaatgtgataacggagacgatattatgaaaaatattgtcgtcatgatttcgggcaatggctcaaatttacaagctattattgatgccattgatactggaaaaatcaacggcagaatttgtgctgttatatctaataaagcgactgcttacggtttagaaagagccaaacaagcggggatttctacctttatttttaccaaaaaagacttttcagataatctggcaatggataatgccattgcagaacaaattgaagcattacaagccgatttaattgttttagctggctatatgaaaattcttactcctgaatttaccgctcgctttacgggtaaaattctcaatattcacccatcacttttgcctaaatatgcaggtttaaatccacatcaacgggcaatggacgcaggcgataccgaacacggcacaaccattcacttcgtcaatgaagaagttgatggcggtgcaattattctacaagcgaaagtgccgatttatcctgatgatgaattagatgatgtgattgagcgtgtttatgaacaagagcatcgctgttatccgcttgtggtgcaatggttctgtgacgatagattaaaacttattgaaggtaaagcctatttagataatcagttattatcgccacaggggtatgcaattgacgattaatctatctgtagaacatatttcagccctttgctctcaaagggttttttatcataaaaaaactaatccgaaacggcaatttatatcgcccagctccattttgaaaatatgatctagatcacattttttccctttcgctctcggtatgatctccgcatcaattcagtaaatcacaaaatgatgaggataatcttatgagcaatacccgtattgaagtcgatctattaggtgaacgtgaagtttctaatgatgtgtattggggtatccatactctacgtgcagtagaaaattttaatatttctaaaaataccatttctgatgtacctgagtttgtacgtggtatggtgatggtgaaaaaggcgactgcacttgctaatggcgagttaggggcaattccgaagaaaattgcaaaagcgattgtacaagcctgtgatgagattttggtgaatggtcgttgtatggatcagttcccatctgatgtgtatcaagggggagcgggtacttcggtgaatatgaataccaatgaagtagtggcaaacttagcactggaattattggggcataaaaaaggtgaataccatattatcaacccaatggaccacgttaatgcaagccaatcgaccaatgacgcttacccaacggggttccgtattgccgtttataacagcattatgcaattgattagtaaagtactttacttacaacacagctttgaaaataaagctgatgagtttgcaaatatcttaaaaatgggacgcacccagttgcaagacgctgtgccaatgaccgttggacaagagttcaaagcattttctgtgttgttagatgaagaagtgaaaaacttaaaacgtaccgctgagttattgcttgaagtcaatctaggggcaacggcaatcggtacaggtttgaatacgccagaaggttacgcaccgcttgcagtgaaataccttgcggaagtcacccagttaccttgcaccttatctgaacacttaatcgaagcgacatctgactgtggtgcttatgtgatggttcacggggcgttaaaacgtacggcggtgaaattgtctaaaatttgtaacgacttgcgtttgctttcatcaggcccgcgtgcaggcttaaatgaaatcaacttgcctgaattgcaagcaggttcttccattatgccagcgaaagtaaatccagttgtgccagaagtggtgaaccaagtatgtttcaaaattatcggtaacgatacttgtattaccttggctgcggaagcagggcaattacaattaaatgtgatggaacctgttatcggtcaagcgatgtttgagtctatcgacatcttggcaaatgcttgtgtgaacttgcgtgataaatgtattgacggtatcacggtgaacaaagagatttgtgaaggttatgtatttaactctatcggtattgtgacctatctcaatccgtttatcggacaccacgagggcgatattgtcggtaaaatctgtgcaaccacaggcagaagcgtgcgtgaagtcgtgttagagcgtggcttgctgacagaagaacagttagacgatattttatcggtcgaaaacttgatgaacccgaaatataaagcaaaacgttttacggaagatgaataattttcgttataatgttacacaatgccaaataattcccttgaaatttaagaataacgccctatttagtagggcgttattttttgtgataaacataaaaggaaaattatgagtacaaaccaagaaacccgtggctttcagtcggaagtcaaacaactgcttcaattaatgatccactcactctattctaataaagagatctttttgcgtgagttaatttccaatgcgtcggacgctgctgataaattgcgtttcaaagctctttctcaacccgaactttatgagggcgacggtgaattgcgtgtgcgtatcagtattgatgaagccttaggcacaatcactatcagcgataacggtatcggtatgagccgtgagcaagtgatcgatcatctcggcaccattgctaaatcaggcaccaaagagtttttaaatgcactcggttcagaccaagcgaaagacagccaattaatcgggcaattcggggttggcttctactcctcttttatcgttgctgataaagtgaccgttcgcactcgagccgcaggcagtgatgcaagtcaaggcgtattgtgggaatcggcaggcgaaggcgattacaccgttgccgatattgaaaaagcaggacgtggtacggacgtgattttacacttgcgtgatgatgaaaaagagtttttaagcgagtggcgtttgcgtgacattatcggtaaatactctgaccatatcggtttagcggtggaaattcaaaccaaagagtatgacgatgaaggcaaagaaactggcaccaaatgggaaaaaattaacaaagctcaagcactctggacacgctctaaaaatgagatttctgatgaagaatacaaagagttctacaaacatatcagccacgattttgccgatccgttaatttggtcgcacaataaagttgaaggtaaacaagaatataccagcctactttatgtaccaagtaaagccccttgggatctgttccagcgtgaacaaaaacacggcttaaaactctatgtgcaacgtgtgtttattatggacgatgtggaagtctttatgccgaattatcttcgctttatgcgtgggttgttggacaccaacgacttaccacttaatgtcagccgtgaaattttgcaagagaacaaagtcacccaatcactccgcacagctctaactaaacgttccttacaaatgttggaaaaactggcgaaagacaacattgaacaatatcaacaattttggaatgcgttcggtttagtcttgaaagaaggtgtaggggaagatttcgcaaataaaaaccaagtggcagccttagttcgctttgcttcaacgcatactgacagtagcgaacaagcggtcagtttgagcgattatattgcaagaatgaaagaaggtcagaaagcgatttacttcttaactgccgacagctatcaagcagcgaaaaacagcccacacttagagctgttcaacaaaaaaggcattgaagtcttactactttctgaccgcattgatgaatggtttatcagccatttaaccgaatttgacggcaagccattacaaagtattactaaatcagatttagatttaggtgatcttgctgacaaagaggaagaagaaacccaaaaagcacaagaagctgaatttgcgagcttcttagagagagccaaaggctatttaggcgaacgtgtcaaaaaagtggtcttaactcaccgcttgaccgacacagcagccgttgtttcaactgacagcgatgaaatgaccacgcaaatggcaaaactattcgctgcaatgggacaacaagcccctgaagtgaaatatacctttgagttaaaccctgaacattcaatggtaaaacgtatagctgatattgctgacgaagcagaatttaacgactggattgaactcttgtttgaacaagcgttactcgctgaacgtggcacattggaaaatccaacggcgtttattaaacggatgaataaattgctaggagcataaagttaaaggggcggctgtcgcccctttatttattgaaataaaccgaagcgaatattgtttaaaagtggtgtaatagacaaataaagaaacattgtatacaaaataatacccaaatttatacaactgttgttacaggtttaagtgagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggccgcgttaaatgatgaactgaccgaccatcttggttatctaaaacgaaaattcagctttgcattgtgcatttagtgcgtaacagcttgaaattcgtttcgtggaaagattacaaagccgtcaccgcagatttaaagcaggtttatcaggccccgacgaaagcacaagctcgcgaaaatctgaccgcactttcgcaaaaatggcaggcaaaatacccgcttgtggcgaaaggctgggaagataactgggcaaatattgccacattttttgattatccggctgatattcgtaaagcgatttataccacgaatgctgtggaatcgcttaatagcgtgatttgtcgcgtaattaaaaaacgaaatgtattcccgacggatgattccgttttcaaagtgatttggcttgcgattaaagatgcatcaaaaaaatggacaatgccgattcagaactggaaactggcaatgaatcgatttatgattgattttggtgatcgcctagacgatcaccgttaagttgaaatgggtgtttacacagaatttgggatagggtcgtttaagtcggtcttatatccttaattattgtataatgccataaacaagttatattcaaactgtgttaaaggtcctctttgggttttactctctaattctcctgttgaatattaccattaaattgaatcccaatacgttttaaattagctttaataacattccctccatagcttgtagtgtcttgcacggcaaaactcaatccaacaggtttagtttgtttagataagcaacctttaatgtagtagcgattgttatcatgtacaacgacatcaagttcacagaaatttgcttcagatttgtcagcaacataggcactactaaatacttgtactggataggcgctaggaacgctaattttaatcagacttccaatagattgatttgcatctaaattcacataaaaacaattttgatcgatatttactgcagaggagggagcgctaaaacagtggcttagatcattccatacccagccgatggctttatcatgactagcaaatacagatgtatctatgatcaaattgccactaatcttatgtatgccctgttcttttaattgtgaaattagttgaaataactgaccgctagttaaagtaggatctccagtaaatttggcgattaaatctccctctagcaccccattctcaattataccattcgtcaagagcgctgtttgaaatttaaaatctgtgttcagcatgatcttagaggctaaagcagtaaatactttttgagtactagctggcaacataaacaggtcactttgataatcgacaacaatttgatcggtagataaatttttagcgataacactgattgatgtacctttaggtaaatgagagatgaacggtgtaatatcgacctctgctgaagcactataaggcatataaaaaaaagagttaaaagtaaaattctaagttgtttgagcgaaaatgaaatcatagtaaggttgctatttttataaagaaaatgaataatagtcgactaatactagattatatctctttttctgccaagacattctctaattttggtaagaacttttctattaaggataaaatatgaagcaaattcctatgacagtgcgtggtgcagagcaattacgtgaagaattagattttttaaagaatgttcgccgtccagaaataattagtgcgattactgaggctagggaacatggagatttgaaagaaaatgctgagtatcatgctgcgagagagcagcaaggattctgcgaagggcgaattaaagaaattgaaagcaaattgggaaatgctcagattattgatgtaaagaatatgattaatactggtaaggttatttttggctctacagtgactttactcaatgtaaatacagatgaatgtgtgacttatcgtattgttggtgatgatgaagcaaatattaaggatggcttaatttccgtcaactctcctatagcaagaggattagttgggaaagaaattgacgacaatgtacatatacaaacacctggcggaaatgttgaatttgatattattaaggtagaatatatttaagttaggaaagtggcagttatataaaagtagatgtaaatatagtttttcatgtttcattgtaagagctcaattatcgtactagtgggagctatatttacataacttgacgcaaactattgaccctatcccaaattctgtgtaaacacccatttcaacttaacggtgatcgtctaggcgatcaccaaaatcaatcatcaatcgattcatcgccggtttccggttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaatcttcgttttaggatagactgcattgatggcttccaggaagccttttaaaccgtctacacaggcaataaaaatgtcttttaagcctcgattttgaagctctgtcagcacatttgcccagaacttcgcaccttcattttcagcaatccaatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttccggtgtttttagatttttggcaaattccgctgccaaggcgtgaagttgtttttcgttcataataaaatacctgtgtctgaatgtattatctcagaaacaggtatttacacaaattgtgggagaggctcatttattgaaatttaattatatttccattcattgatgatagttttatactttcaataacctctattgattctattgccgtttttatatttgatacaggttgttttcctgtttcaataccttcaattagacttaaaatggcatctatcattctttcatttggagtagtattgtgttttgaatagactaaatctaaatgttcatacttgctacctgatgaattttcactacttgaaaatttatataaatcataagatgatccattgttgtataatcttattcgcccattttcgccaagtatgtctaattcaaacatatatttcattggggaagaactagtacctttaatgaacccaatagaattagacttaaactttatcattcctgttcctccgacatcagaaataccgtgaacatttctcacaaaatctttttgaatatctccaacaacatattcaatatctgaaccagaaaaataaagcaataaatctattaaatggcttgtactcgtatgtaaagcagttgcaccataaccaactaaagaataaatattccctatagcatttgaatctaatagtcccttgatttcttgaataagattatcccaacgaaaaatgtaattaacagcgataataacattatgcttatcgcataactcaactatttccttagattcttctagagaataagaaatagtcttttcacagaaaatcactttaactccattcttaatacactctttgatgatatcaaaatgtgtttgaataggtgtacatatactgacaatatcaaatttattagatttcagcatttctttataatctgtatatccatttggtatatcacattctttttggatagaatctaccaaagatttcttaacatcacatactgatgatattcgtatattttcaatacttttatatgctttaatatgactccatatgatttttctgtttggatctttatctataccataagcaatcaagcctaatcctataacacccacattatacatattaatctccatgggattttttcctcaatgaaataacacatcctacaataacgattgcagcaccaaaaccttgataaatagaaatagtttcacctaaagtaaagtaaccaataaacgcagtagataagggaactgttaattgaataatattgaaaacaactaccccttgtttttgaacaatataaaatgcaaataacatacctgttagcactccatacattccagcaaagattaatccgatcagcaagcctgaactaatatcttgtaattgataaataacacctgtattacttgctaaaagtagataaacaagtccagataaagtagcagtggatgcactgataacgatggcatttaatttttttgcgacctttttaacgaaaaggttttgaatagattgaataaatatagctgtccccaaaaagagtgaccctgttataaaatcattacccccaccagttttgttgctataaattacaaatatcaaagaaccaattacagataagacgcttaccaatataaaagctcttttgttttactttttccctttcatcttgaaagaaaattgcggccataataacagctaaaggcatagacataatgccaaaaatactgcctgctaaagctgaagtatatttaagaccattaataaaaaaatacatattaccagtcataaaaatagctaacaaaagaagatataagatgattgaaggttctctgagcaacttaagtagttctgttctatattttaatatacaaataaaaacgaataacaacccaccagagagaaatcgaacagcattattatttaaagtatcaaaatgaatactcatataacgcataataggaaaaccaaaacccattaacaaaacataagaaaatcttataaaagaatcattacccatacgactaagccccatacctaaaaggtaagtaagattaggtaattataaaatatttgtattgtttctcatagaaaaagagcatagattttgacatctatgcccttttcctataatctgtttcgtgcgttctttgctaagataacactaagataacagaccctagacaagtcatatcttagcaaagggtagctagtaatgcgaccctatcccaaattctgtgtaaacacccatttcaacttaacggtgatcgtctaagcgatcatcaaaatcaatcataaatcgattcatcgccggtttccggttctgaatcggcattgtccatttttttgatgcatctttaatcgcaagccaaatcactttgaaaactgaatcatccgtcgggaatacatttcgttttttaatcacgcgacgaatcacgctattgagcgattccacggcattcatggtataaatcgctttacgaatatcagccagataatcaaaaaatgtggcaatatttgcccagttatcttcccagcctttcgccacaagcgggtattttgtctgccatttttgtgaaagtgcggtcagattttcgcgagcctgtgcttccgtcggggcttgataaacctgctttaaatctgcggtgacggctttgtaatctttccacgaaacgaatttcaagctgttacgcactaaatgcacaatgcaaagctgaatcttcgttttaggatagactgcattgatggcttccaggaagccttttaaaccgtctacacaggcaataaaaatgtcttttaagcctcgattttgaagctctgtcagcacattcgctcagaacttcgcaccttcattttcagcaatccaatcacggtcacgaggcgtctcaatttctatctcaccttcatcacaaatgacggtcttagatgtgtaaccgttacgtgcatttttaccttttttaggctgatgtttttaggtttttggcaaattccgctgccaaggcgtgaagttgtttttcgttcataataaaatacctgtgtctgaatgtattatctcagaaacaggtatttacacaaattgtgggagaggctctcacaaatcgacggcagtaattattttttcatctacttcagaccattttttctttaacgacttcccattccatttcattgaaattcaaaaagtatcgccatcaattctagtctgaatttctgttagataaagtgtatttgtgagaggtatagcttgtttaagtagcttgcctcccccaatagtcatgatttcattgctactataaaagcctattcccattgttgccgtgcaagcgaacatcagaaagcccattatttggcaacgctgttcatcactagacttggactataaagagaaaataacagcgcatataatgtatttccttcataataaaaagaaatgcgcctactaacgactacttaaacagtcatagatagacgcataattaaactataataacgacggcgctgcatctaatagaattttggtgtactcttcttttggtgtgtcgaatacatcggcggcattaccttgctcaacaattaatccaccattcattaccacaattctatctgaaacttggcggacggtttgtaaatcgtgagagataaacaccatcgcaagatttaactcttttttcagatcggctaacaggtttagtacctgcgcacgaacggatacgtcaagtgctgaggttggttcgtctgcaacaatcagttttggatttaacgctaacgcacgagcaatcgctacacgttgtttttgtccaccagataaacgagttggctcaacaagtgcggcggaacgtggtaaaccaacacgagaaagtaagtcgtaaacacgtttttcacgttcgtgcggttgcagtacgttgtgaatatccatcgggtctttcaaaatatccaatactcgcatacgagggtttaacgctgttgccgggtcttggaagatcaccgatacttgacggccaaactgtttacgggcttctgcactgccgtatttcatttgtaagccgttgaatttggctgtgcctgatgtcggtttttgtaagccgataatcacgtttgctagggtagattttccgcaaccagattgtcctactaaaccgaccgtttcacctgcattgacttctaagctcacaccgcctacggctgtgaattttttcgggttaaacagcgtgccatcacgagatgggaaccgtacaacaatgttctctaattcaatgataggctgttcttttaatggtttcatactcattgtttatccctccaaatgtgaagcccaaaggtgtttcggattgtcgcttgctggtacaagtttcaagcgttgatttggatttgcatctggacgtaatgaacggcttgcaaagcggtcgcctttcgcaaaatcaaacggtgatggaacactgcccgggatttgatataaacgctctgcacgacattctgttgagagtacagaaccgagcaagcctcgtgtatattcgtgtgttgggttagacaataacgctgaagtcggtgccatttccactacttgtcctgcgtacattacgatgatgtggtgtgccatttgtgcgactaatgcaaggtcgtggctcacgaacaccattgcaaagccaagtttttcacgcaattcgttgagtaatttaattacttcggcttgaacggttacgtcaagggctgtggttggttcatcagcgataagtaattttggttcacgtgctaatgccattgcgatcaatacacgctgacgctgaccacccgataattcgtgtgggtagcggtttaaggttttctctggatcgagttttacccattttaatagggtttcagcagattgtttaccaccacggctgataagctgtgccatttggtctttaatacgcattgatggatttaatgcacttaaggcatcttggtagatcatagagatctcgtgtccacgtaattcgttgagcttatcggtttttaagagatcgtgttggttgcctgcacggtcggtaaagagaatttccccagtgattttggctgtcggtggtaataagcccataattgagaaggcagagatagatttaccacagccagactcgcccactaatcccattgtttcgccttcattaacggtaaagctgatattatcgacaagcggaatatcgccataacgatttgggaaacggattgagaggtttttcacctgtaaaatcggttttgcatttgggtttaattgcatacggtctgtgcgagttgcttctttctcgtgcaatttgagtaagtagcgttttaatgcaagactttctgccattgcttcttgtacatctgttgaaagcggttttgatacgtcttcttttgatgtggttgggctacgtttcaattttggattgactaacgcgtcagttaaaccttctgagagaatgttgagcgagagtactgttaggagaatagccaaaccagcaaaggttgttgcccaccagaaaccacttaatacgatgttacgtccttctgacaggatatttccccaagatggttgtggaagttgtacacctgcacctaagaaagagagagaagcctcaagtacaatcgcatcagctaccattacggttgcaaagactaatacaggtgcggctgagttgcgaacaacgtgtttgactaagatgtaggtacggctaccaccgataacacgttctgcacggacataatcttcttcccattgagaaaccacgttagcacgcaccacacgagcaagttgtggggtgtaaacaatcgcaatggctaagatgataatcggcactgcgttacctaaggttgcaagcaatactgcggcaagtgcaatacctgggaatgccattaagatgtccataaaacgcataatgacttcgttaccaagtttgtctgcggtagcggctgttgcccctaagatacttcctagaacaatggcaagtcctactgcaccaagtccgataaagagtgatgtttgagcaccgtaaattaagcgagataaaatatcacgtccaagacggtctgtcccaaaccagtaatctgcatttggtgcttgaaccgggcgaagggtttgcaatgggtcgtatggtgatacccacggtgctaaaatagccagtaatgctacaagcacaataaatcctaatgcgagtttagaggcggttgataatgctttaaatcttgccccgcctgaagcaagtctatcagctaatccttggcgaaacattataaactccgaatttttggattaatcagtaagtaaagaatatctacaatgatattcaccaagacgaaagtaaaggcgatggtcaatacgaccccttgtacgaggtgtaagtcgtggtttacgataccgttaaaaatcaatttacccattcccggtaagtcgaagatttgttcgataaccactgcaccacccagtaggtagccgacacgcaagcctaaaacagtaacaggggtaattaaggcattacgcaatacgttatgacgaataaccgttgcataaggtacgccattaccaattgctgtacgcacataatctttgtccatttcttctaccattgtggtacgcaccacacgaattaatgacgcacatacagggattgccaatgctaatgctggtaatgccattgaacggaaatactctgttggatcttcactaaatgacacaaacccacctgatggaagccagtctaattcaagagagaagtattgaattaataagatacctaaccagaatgatggggttgccactgccgctactgagagtaggcggataacttggtctgcccaacggtcacggtagagtgccgcaataatccctaaagagaatgatacgattgctgctaaaaagaccccaatgaaagtaagttgtaatgtaagtgggaaggcttttgcaatcaatgaggtgattggctgttccggcggtgtggttagaccgaagtcaagtaccaaaacgttaccaatgaaacgaaagtattggacgataacaggatcgttcaatccgtgttgttcacgatacaattctttcgcagcatcacttgcactttcacccaatgcaacagaagctggatctccaggtgtgaactgtagaatgataaaaactaatgcacttacgccaagcatcatcagtggtaatgccattaatcggcgtagtaacagacgaagtacgatttctatttttttctccgactacaagaaaggttagtgggataggtttatataatttttataagaaaagcggtgagattaccgaaaaggtttacaacttttacaacaatcttatcgcttgaaagaaaccttaagtaagacgctactttaaacgccttcacccgaaggtgaaggcactatgattatttacggcttacaccaatgaatgacatacctgtggttgataatggtttaaagccatctaatgctttgttactccaagctgttggaagtttacggtgaataattggataaagtgctgcttcttcagcaatgatgttaatcgctttaccccaaatttcacgtgcttctgccggagttttcgcagccaccgcagcgtcaagaagtttttgaacttccgcatattcaggtgtatttgaccagcggaaacgttttttcggccatacatcaccacggtaccaccagcttaataataagtctaagtcgttaccgaatactgatgggtcacctggtgcgattaatacttcaaagttacctgcatcaacaccgtcattgtatggtgattgtgaagcgatgtttgtcacttttacaccagggatcttgttccagtcttcaaggatcatttgaacagagtccactacccatttatgtgcggttgaacgtgttgtaaactcaagtttatctacacccgcttctttcaacaatgcagccgcttttttcggatcgaaatcatagactgttgaggctttcacatagtctgggtgagagtcttgaacataagatgtcgcaggttttgcgttgcctaagaacaccacatcaactaatttttgtgtatcaattgcatattgtaatgcttgacgtactttcttgttgttaaacggtgctttttcacagttaaacattaagaaaattaagccgaatgattgcactgattctacagctgctttacgttttaagcgatccgcatctaagtaaggtacgttttcaatcgcttgtacacgacctgactcttgtgctgcaacacgtgctgcgtcatcagagagtaagaaccatgtcattttttcaacagttgcaggatatggacctgtgtaagcagggtttgcttcaaatacgatacggtcatctttgactgctgaaacaaatttatatggaccagtaccaacagggtttgcatcaaagactgattgaccttgagcttcaattaatgcttttggtacgattttgataatggttaaacgttctttgaataatgcaaatggatatttcaatttaaattcaactgttttttgatccactgcagtgactgatttaatgaatgggatgaattgtgcaaagagtgattttgtatttggatctaatacacgctcaaatgaaaacacaacatcagcactggttactgctgaaccgttatggaataccgcaccgtcacgtaaagtgatgcgataagttacatcgtcaactttttctggttctttcgctgcaagtgctagatatggctggcgagttgctgggtgtaaatcaactaaaccttcaaaaatgtggatattagccgccattgaagatgcaccagttgaactcattgggtcaaaacccgttgaaatcggataagcaatacctgcttcgatagttgaaccttttgctggtgcagcataagcctgagaagcaaaagtaccgattgaacctgagaatgctaaaccagcaccaacacctgcaactaatttcataaagccacggcgagattcattgtgttcaaaatgtttagtcacattagactccttgatagtatcgtttttgtaaaatggttatgtgcagtacaacacacattaaacaaccaaaaagtttcgtatttacttctcattttcaagtgaattaatcaaaatgaaaggtaaaaaatgaattgaaaacattataacactaatcaaggcgatgtcaatatattgtcaagacgagtatttacatttgtgatctacttcacgaaatcagaaaataatctagctttagctaggcggataaccgacatcttctaaagtaggattatttgcaccttcttttgctaattgatcacaaatttcattttctgtatgtccagaatgacctttaacccattgccattcaacctgatggcgtgttatggctttatccagagctatccacaaatcctgatttttaactggcgtattattactggttttccagttatttttcttccaattaaaaatccatttttgaataccattttgcatatattggctatcgctatgcaaatgtacattacaaggctccttcaaggcatttagagcggtgatcacggcaagaagttccatacgattatttgtcgtcaagtagtaaccctgacttatccgtttttctttgccttgataacgcaataaaatacctatgccacccttacccggatttcccaagcaagaaccgtcagtgaaaatatcgacaagtttcattggggttatagtacgatagttttattttgataaacaaaaacacgatcagcaagcaccaattctaatgctctgctcaataccgttttttctacatctcgtcctgctcgcatcatcgcatctgccgtataagtatgatccacattaatcacattttgcataataatcgggccttcatctaactcgttattaataaaatgtgccgttgccccaataattttaacaccacgctgataggcttgctgataaggcttcgcaccgataaatgcaggtaaaaatgaatggtgaatgttaatcacacgatttgggtatttcgccacaaactcagggtttaacacacgcatatattttgccaacacaatataatcaggggcatattcatcaattttatccgccaataatttatcgtgttctacacgagttaaaccttcgtggcttactaaatggaaaggcacatcaaaacgttccgctaaacttcttaatgtatcgtgattaccaatcacagctgcaatttcaacattcaaaccaccataataggtcttcattaaaatatcacctaaacagtgtgcttctttagtgactaaaatgacaatacgtttacgttgttgcggaacaagtttataaatagatccttttggcaaggtaaattctaaatcggctaatagggtctgatcgttgaaaataccttgtaattcagtacgcataaaaaagtggcgagtatcactttcaacaaactcactatttttaataatgtttaattgatgtttataacaaatattcgtgattttagcgacaagccccgtatcatcaggacattccgttaataaaattttattttcaatcattttgttttctctatttattagaaaaatagctaattcatatcaatcataaaaaagaaaacccacatcttgtgggcttctctgtattcatatcaaattagattgcaaaatctgctaatgatttacccgcttctaatgcttgttgaatttcacgaggcgttctgccttgacctgtccaagttttttcattaccgtttgcatcaatgaatttatattttgctggacgaggatcacgttttttacgttctactttggttgtacctgctaataataacgcaagttcttctgctgaaataccatcttgagcaagtaactctttgtatttatttaggctttctagacgttttgctttttcttcttgttgaactttaatttcttcacgtttttcttcaataacaagtgcaattttctctgcgataagttccaattgttcaattgaagcttcacgagcaattacacgcaagctacgaatatttgaaagcgtttttaataaatcagtcattgttttctcctaaatgtaactagttcatatcaatttagacttttttttatattatcgtaataattatttcaggtaaatacacaaaataaaattcttattatattttgataataacttaaagcaaactagaataaatctgacatattaatttatcaaaatccatctttcccctattggcaaccgccgtttcttcaggtaagctattagtgtcctacaaattgtagaggtgcgaatgcgataagtattctttcagagtggaaaacgatgaagaaagaggaaaggcgtattcgccgaaatcaattaagcgtcatcttaattggttggtatcgttatcgaaaggaacgatactgtcatagcggaggctatggagtgctactgttaggctgggtttattctgtttttcttttgttcccttccctaaacaccttgcttcatcaaaagtaagtttattccagtagatctctttctttgtttgacgtgttattttattaaaaacaatctgagaggttttatgaatctagttgattattcaagttcattatggtctgtagtgcctgcattattagcattggtacttgccattattactcgtcgagtattactctcattaagtatcgggattattgtcggtgcgttaatgcttaccagtggtaacccgattgatacctttttacatttgaagaaaaatatcacttcgttaatttatggcgaagaaggattaaattcaaataacgtaaacatcattcttttcttacttttattaggggtactcaccgccttattaagcatttcaggcagtaaccaagcctttgtaaattgggctcaaaaacgtattcaaggaaaacgtggtgcaaaattaatggcggcggcgttagtgttcgttacctttatcgacgattatttccacagccttactgtaggtgcaattgcacgtccagtaacagacaaattcaaagtttctcgtgccaaattagcttatattcttgactcaacagcagcgccaatgtgtgtgttaatgccaatttcaagctggggtgcttacatcatcactttaattgcaggtctattaaccacttacggcattacaaactacactccattgggtgcatttatggcaatgagtgcgatgaacttctacgctattttctcaatgattttagtctttgtagctgcttatttctcaatcaacttaggctcaatggctcgttttgaacaacaagctgagcaagctgcagatgttgaagagcaacaaattgtcgaagcaagtggtagtgtgatgaacttaattttaccaatcatcaccttaattttggcaacccttgcaatgatgatgtacacgggtaaccaagctctagcagaaagtggcaaaccatttgatgtattaggcgcatttgaaaatactaccgtaggtatttcattggttgtaggaagtttgagtgcattagctgtagcgactttaatgattgcaataggacgtaaagtaacaatgagtgattactggaagtcgtacggtatcggtgcaaaatctatgatgggtgcaatcaccattttattctttgcttggacaattaacggcatcgtaagcgatatgcaaacaggtaagtatttatcaacccttgttgctggcaacattaaccctgcatttttacctgcaatcctctttacattaggggcagcaatggcattctcaacgggtacaagttggggaacattcggtattatgcttccaattgctgcggcaatggcagccaacgcagaaccagcattattattgccttgtttatctgcggtaatggctggtgcagtatgtggtgaccactgctcgccaatttcggacaccaccattttgtcttcaacaggtgcacagtgtaaccatatggatcacgttacttcgcagttaccttatacgcttgtcgttgcggtggcttcagcagtgggttatttagtgattggttttactacctctgcattcctcagctttgcagtaacagcagcggtcttagttactcttgttatcctattcaacgtaaaaaatagtgatatcagctcttatagtaagatatgagtaaaacaaagcgaatcctcgtaattcgctttgtttatttatagcaaccggttaaaatagctcgatttttttacattttatggatagattatgcttcccgaactgggttatttctgtttagtcttattagctggtatttcagggttacaggttttatgttccttatggggagaaattcgccatcaacccttttggttgagtggaaatcgcctatttagtttaattcaagccttattagccttagcctgttttggctgtttagcctacgcttttatctatgatgatttcagcgttacctatgtcgctgctcattctaatagtcaattacccacattcttcaaatttgcagccacttggggaggacacgaagggtcaatgctgttttggctaacggcattggcattatggacaggcatattttgcattttttcaggcaaaatcgaccgcttgtttacttaccgcaccctcgcctctctcgccttaattattttaggctttgctttgtttattctcttggtctctaacccatttgagcgtagttttcccccttccccagaggggcgagatcttaatcctatgttgcaagatgtcggattaatttttcacccaccactgctttatttaggctatgtaggctttgctgtcacatttgcaatgacaatggcaatgttgcttggtggcgtgtttgattatgctattgctcgttggatccgcccttggacaatggtagcttggggatttctaaccgcaggcataatattaggtgcttggtgggcttattatgaacttggctgggggggctggtggttttgggaccctgttgaaaatgcctctttaatgccgtggttgcttggtactgctctgttacatagtttagtcgttagcgaacagcgaggcatttttagttattggacgattttattagcgatctttgcctttgcattaagtctgttaggcacatttattgttcgttctggggttcttacttctgttcacgcatttgcagtggacgcagagcgaggaatggctctgcttattttgttctttagcttgagctttgttgcattggctctattcgctttacgagtgaatttatggcaaggcaatgttcgttttcatctgttttcaaaagaaacggcattattattggttaatggcttatttgcattagcaacgctggtggttattcttggtacattttatccgatgatcttcagtgcaatgggctggggctcgatttcggtcggcgcgccctatttcaatacgattttcacccccttagcattgattttgttatgcctaatgggatttgcaatagtgctacgttggaagcatattccacaacgtcaaatcttgtggcaactggcgttactgcccgttgcggtgttgctcagtttgggcttcagttatcaagttttgcaacaggtctatgtacatcaattacagtggcaacccactctttttatctcactggcaatttgggttgtactaactcatctaccttatcagcgatttatgtggcaaatccgaccgcttgcaatgcgactggctcacattggttttgcgataagtgtgattggggcaatgatgaatagctattatgctgatgaagttggggtgagattaaaaccaacgcaatctgctgaattagcggggttacgctttgaatatgtcaaacaccacaatgaaattggggcaaactacaccgctgaagtggcagagtttcacctttatgatcaacatcatcaaaaattggcaaccttattgcctgaacgccgttactatgatgtccgcacaatgacaatggcagaagtggggctagcccattatggtttagatgatatttatattgtgatgggcgataagtttggtaataaagagtacgcatttcgtctgcactacaaaccttatgttcgtattttgtggctaggcggtgcaataatggtcttggcgagcctattggcattggttggttatcggagaaaaaaatgaaaaaaggattgctgtttttaccgcttgttatcttatttgcggttgtactttttttagtaatgcaattaaaagaaaaagacaatgtgccgttaagcgaagattggcaaggtaagccgttacctgaatttagcttaaaacatttactggataatcaagcggctatcagtaaagcaagtttactaaatgagccttttattttaaacgtttgggcgagttggtgtacttggtgtattaaagagtttccgattttacttgagatgaaacaacaaggggtaaaaattgttgggctgacctacgcagatcgccccgaaaatgcacggcaagcccttgctcagtggggaaatccatttgagcttgtgattgatgattgggataaaggttttttaacggaaaccctcagaatttcttctgccccctcaagttatctcattgataaaaatggtattgttcgttaccaacaaaaaggctacaaccctaattttgctcaagattttatgcctcgtttgcaagcattgaaggaacaggataaatgaaacggatcttatttttactgttcagttttatcgccctcgtagctcaggcagaaatggtggacacctttcagttccattctgatagtgagcgtattcgtgcgattaacctagcgaaatcattgcgttgtttacagtgtcaaaaccaaaatctggtagagtccaacgcttctcaagcctacaaattacgtatagaagtctatgaaatggtcaatcaaggaaaaagcgaccaagaaatcattcaaataatgacagatcgcttcggggacttcgtccattatcagcccccctttaatcctcaaacgtgggtgttgtggggaatgcctgttggcttacttgttctactctttagcctgattttttggcgaacacggagaaagcaaaatgattaggaacgaacttaatcgggcttattatcaacaagcggaacgatttgccgatacttttgcagaaaaagagcgtaatgaatatttagccgaattggcaagccgtcaagcgtttgaacaacaaaatgatgtagtatcgcaatggcagaaaaatccacttaaacgcccgcttgtagtaaccgttttgttgattgcccttgtcgccagccttctctattattggcagacagggcgttatagccttgctattcaaggggagcaggcttttgctcaatttcaacaacagcgtgcggaagaaagtagtgaacagcgtaatgatcactatattaccaaccttcaacatcagcttcgccagaatgccaatgatggcaaactctggtttgagctagggcaggcttactcactcaataacgatttcgaggcagctttaacttgttttcgtaatgctcagactgtactgggcgaaaaggcgagtattttaggtgcaatggcaacagccgattactatttgaataaacagcgactttccccgcaagcaaaggcttggcttgagcgagcgttacgaattgatgataaagagagtgccagcttgcttttgcttgcctccgatgcttttttacataacgatttcaaacaggcaattcattactgggaaaaagtattagacaaccagaacgaagccttagatcgtaaagagatcattcaaagtataaaaatggcggagcagatgttacgtgagaaatagtgccatttatggttgtttgatattgatcatcacaataatattttaaaagattctaaatttttaatcttagtttttctttatagcaaacaacaccaactctctcatctggaaacttaccgatacttttgcttccagtggcaaatctgccgtttggtaagcggtaacatttgtgccgtttattgcgatttgataacggtagaattgccctaataacagtttttcaatcactacaccttgcccgttatcatcggcttttagggtaatctgctctgggcgaagcaaccaatgataatcgccaagcggatactcgatttcagggaattgataagtaccaatcgggctttcaaggaagtgattttctaacactttgcacggcaggtagtttgtgccacctaaaaagtcagcaacgaaagcgttcacaggggcgcggtagagttcggttggcgtaccgaattgtacgatcttaccctgatccatcaccgcaattttatctgcaaaggcaaaggcttcttctttgctgtgggtaacgaaaatcgcagggactttttggctttttaagatctgtttaatctcttggatcatcgcatagcgagtttggctgtcgatgttggaaaagggttcatcgagcagtaataattcaggttcacaagctaaagcacgggcaatggcgacacgctgttgttgtccgccagagagttcgtgtgggaagcgtccttcaaagccttgtagtttcaccacggataacatttgctgggtgcaacaatgttggtcggatttacacattttgcataagccgaattgaatattttgtgccaccgttaaatgcggaaagagagcgtaatcttggaaaatcagcccgatttgacgctgttcaatcggttttttctgtaaatcttccccagcaagaaaaatgttgccttcgctaatcggaagcaaacctgcaatcgctttgagtagcgtcgttttgccacaaccgcttgctcccaatagacagacgatttcattttcgtccacggcaagatcgagggattttagtaccacattgtcgtcaaattgacagctcaaattttgaatatcaagtaatttcatattaacgttctttttgcgattgagagattaacgaacgggtcagccaaataacagggattaatccgactaacaccaacacaatggctggcaaggcggctcgctctaattgttcgtccgaagtaaaggtgaaaacgtgggtcgctaaggtatcaaagttgaacggtcgcaataacagtgacgcatttaactctttcatactttcaataaagaccattaagcctgcggtaataattcctttggtaatcaaggggatatgcacacttctaaacatggataagcccgtttttcccattgtctggcttgccatatccaacgacggtgaaattttgccgagtgaggtttcaaggctaccgattaccattgcagagaagcggatcacataggcaaggactaaggcaaacagtgagccagaaaaaatcaagccgacaggggaaagctctaaagatttcagtagcgcgtgtagttggtgatcggcaaaggttaatggcgacaacaagccgattgccagtacagtccctggaatggcatagcccaatgaggaaaattgtaacgacaagcgggtcgatttcgtccaaaatctgcgattgaccgacagacgatgagcaaaatgcagtaacagagcaagggcaacggtaatgatcgaggcaataatggatacttttaagctatttgaggcaaattgcacaaaatctaaattccacgactgttcaaaatagtggaaagaccaatagattaatcgaccaaatggaataaagaacgccaatgccaacaacccccagcaccagccttgtgcaagccacagtttccagcctgtgagctgtttgaacgaggttttcttttcatagccacgctgatagcttttttgtttgcgacggctgtattgctcaaggctgataaacagaaaaatcatcagcaacataaaaatggaaatacggcttgccgtgccgagatcttgaaagccgagccacgagtcgtagatggcagtcgtcaaagttggcactgcaaaataggacaccgtgccgaaatcgcctaaggtttccattgcgactaacgccataccgacagcaattgcagggcgaattaaagggaaagtaattttacggaaaatatccgctggcgatgaacctaacattctggcactgtgagtgaggttttccgattgttctaataatgccactcgagccagtaagaaaatataagggtagagtacaagggctagcacaaagcaagcaccgtaaagggtgcggattttcgggaaccaataatcgtgcggtgtttgccaaccgaaaataccacgcaacatttcctgaaatgccccagaatagtctagtaaatcggtataaagataagcgattaaataagcaggcattgctaacggcaagcaaagcaaccattgaagcgttttttgcccacagaattgataattagcgacgatccaagcggacggtaatgcaaaaaaaagtgcaaggacgacagtgcctaagactaacaggcttgagttaagcagataagtgcctagcattgtatcccagagatgaacgagattttccatttcaccttcaaaagcgtgatagccaatggcaagcaacggaagaaggattaacagcgtagttgcaagggcggaaagttgccaagtcaggtatcggtttatcataaatcgatcaaaatctcattccattaaaaaacaaaattccccctttgcgaagaagggggtagaaattaaattcgacgtatttgtagggacacgacgcttcgtgtcccaatatccacattggttgtgtattagcattggacgccaagcgtggcgtccctacaaacgttacaatattaattatttcgcaccgaaatcatcaaatttaacttcatcaactaatttcaatgctttttcatagtttttcgcaatgtcttctaattttaatgcatcggttgagtaagttccccagccttttacaagatcagaaggtgcaacgtcagcttttactgggtactcgtggttaagtttagcatataaagcttgagcttggttgccactgagatactcaattaatttaattgcatttgctttgttcggtgaatgtttcgctaatgctacaccactgatattaacgtgtgtaccgtattgaccgttagggaagttaatgatcgcagactcagcccaagatctttgtttttcatcatctaacattttaccgtagtagtagctgttacctaacgcataatcacaaatgccttctttgattgctttaacttggtcacggtcgccaccttgtggtttttgtgcaagatttgcttttaagccttctaagaatgctttggttttttcttcaccgtagtgttcgatcattgcagcaaagagagaaacgttgtaagcatttttgccagaacgaacgcacactttgcctttatattcaggcttagctaaatctaaatagtcaaacccagcaggtaatgcacctacacgatcttttgatgtataaataacacgagcacgtttggttaaaccgaaccattcgccatttgaatcacggaactgcgcaggaatatttttctctaaagtttttgagtctactttttgagccaagccagctttcacaatttgcattacacggctaatatctaccgttaaaagcacgtccgcagggcttaattcgccttctttttgtacacgttcaactaaacctttgtctgcaaagatcacgtttactttgatacctgtttgtttttcaaagtcttttaacatcggctcaattaagtacggctgacggtaagagtaaacattgacttcgtttgcagctaacgcagaagttgaaataacagaagataatgcaagtgcaagcacagaaagagattttttcataaaaatgtcctcattaggaaagggataaactcactataaatagcgagcgtttacaaaacagtgtgagtttaaaatgtttacatttttatgtcaagtaagaactatttttatttactaatgggtagttaatctcattcttaataagatgaaaagtgaaacctttttggggcatcctatagtcgcagcatattatccggtattatgaatcaagtgcacaaatacctcatttcaataaaatctgtgtataatacctgctgttttgttagcaataattttgctttcaatgaagttaatgtttgctcgtataattttgtactgccttcgtgattaatagagcaacagactgtaaagcctatgttaagcagagtattgtctttttcatttaaattattccgtaaattaagataggttaaaaactaacttaattgtgcaaaaagaaacaaaatgcaatcaagatttaattgataaacattaaatttagcgtctaaaaaatatttagagatgaaagaaaggttttaacgattattcaaatagcatttataaattaaatctattgaattagatcaaaataaccgtagttttttatagggataatatattcgctttttactttatggagtgttaccaatgaaaaaactactgttatcagcgattgccttaggcgttgctggatttttagggatggttgggtatttgcatacctttgaccaagaccaagcagcaaaactacttgcacaaactaattttagtggtaaacagcaagaagtggcgaaagtcttttttgaaaatggctgtcagtattgccacagtcctaatgcagaaatgcctttctatgccaaaattcctggtgtaagttcaatgatggaaaatgatgttgcaacaggcaaccgctttttccgtttggataaaatgttagaaggaatgaaagatcctgctaaattatctgaagcggatctggctaaattagaaacggtgttacgcaacgatacaatgccaattgcgagctttattcatattcactggggttctcgccctgatgagcaagaaaagaaaacggtgcttgactggatccatcaacagcgtgcggagcattttgttccaaaaaatacggctggagttgatccaactcgcttagttcaacctattcctgatgcattaactacagatccacgcaaagttgccttaggggatcaaatctatcatgacgggcgtttatcaggcgatggcactgtggcttgtagcaactgccaccaattagataaaggcggtgtggacggcttgactacatcaacaggtattcgtgggcaaaaaggcggtatcaatgccccaacggtatataacgcagcctttaaccacttgcaattctgggacggtcgtgcgaaagatttagcggatcaagcaaaaggcccaccgcttaaccctgtcgaaatgggttcacatagttttgatgaaattttagcgaaattcaaacaagatcacgcttttatgcaagagttcttagcggcttatcctgaattaaccgcagacactttaacagatgccattgcagaatttgagaaaacgttgatcacgccaaacagtgctttcgacaaattcttaaaaggtgatcaaaatgccctgaatgacgcacaaaaacgtggttacgaagcatttaaagcggcgaaatgtgacacttgccatacaggtaccgcaatgggtggacaatcctttgaatatatgggcttatatgatgattatttcaaaacgcgtggcacaccaattaccgcagacgatcacggtcgtttctcacaaaccaaagatcctgctgatatgcatcgcttcaaagtaccaaccttgcgtaatgtggctttaaccgccccttatatgcacgacggtagcgttaaggacttaaaagaggctgttcgagtaatggctcactatcaaagtggtaaaaccttaaccgatcaagagttgaacgatattacttcattcctagaagccttaaccggtgaatatcaaggtaaagtattaactcgtcaggattagcataaattgctaagtcgtcacaaaaacgatataggagaaattaatctctgacatatcgtaagaacaagaaactaaaagggctgaaatcaatataatattgttttcagcccttgattaataatttagatttatacaaaccttccttgcttaattttcatcaaacaagaatttttcaaaacattagcgacgtaaacctaaacgtgcgatagtttctgagtatttagcaagatcagtacgttttaagtagtctaataatttacgacgacgtgaaaccatacgtaataagccacgacgaccgtggtgatctttcttgtgctcagcaaagtgtgcttgtaagtggttaatttgtgctgttaaaagagcgatctgaacttctgaagaaccagtatcttttgcatcacgaccaaattcagcaacgatttttgcttttgcttctacgcttagagacattttttactcctaaaaagtagttaagtttatattcatcaatagccgatctctaattcagctacgacacgaagttgcgtattctaaagagaaaagctgtcaagagcaatgcttttctctcagaatagcttaaactaatgtttggtatccgattgactttgtggttgtagatattcttctcgattcggatcaacttgttttgatttacgaatcattggctcaatagttgtaccttgtaccaaaatagagaacatcacaacagaatatgtcatcaccagaattagatctttaacatcaataccattggcataagcagttttggctggaatagaaagtgccattgctaatgccaaacctccacgtaatccgccccagctcatgatttttaaggtatatggattgtaagtacggaactgttgtagcgccttatatggtaaccataagctgatatagcgagatgctagacaaatcggaattgtcagaatcatcatcacaataccgtagatattaaaatcgacgagtaagatcgcaaaaccgataaggaagaaaagcagagaatttaagaaatggtcaatcatttcccagaagtgatcaagataacgttggctctgttcagaaaagcctgaacgacgggtccagttaccaatcataatgcctgccacaatcattgccaacgcacctgaaacgtgcagaacattgtttgcaaacataaagcctgcggttggaatggtcaaagttaataaaatttctaagctaccatcatcggttgatgaaattaaaatatgagcaaggaagcctagcacaaatccaaacaggataccgccgatagcttcatgcaaaaagaggctcataattccactaaaactggcttcttgaccaccaaatgcaacagcaaacacagtgacgaagataactaaaccaacaccgtcattgaaaagcgactcaccttctacttgcatagataaacgcttcggtgctcgtaaatttttgatgatcgcaagtacagcaattgggtcagttggagaaatcagagcaccaaaaacgatacagtaaatcaaatcaatttgtagcccaattaagttggctaccccatagacgaagaaaccaataatcaaagttgaagctaaggttgagaataacgcaaaaatggtaatttcccatttttgatctttaagaacagggagtttaattcctagtgaacctgcaaagagtaggaaccctaaaataccgttaagtaagaaactcttgaagtcgatctgttccatgacttctgttgcgacagcatcaaggttaaaccagccgaaagttccgagtaacagtagtaagagagaaccgatcattgctgcagctgtaatagcaatggtcgattggattttatcgctgattttatgagtaatgaaacctaataaaatagaaagtgctgataaaaaacagatataagtataaatacccatgatggtatccttatggagacaaaaaagaaagatccttgttataaatagtctgcaaattaaaccaaatttttaatctgattgcaaaaaaataaaagatattaagtgagctatttcacaagtaacaatttgagaattttccactttaacggtataattaagagtagttttttgtaattttagggatcataaagatgattgaaaaaatgcatgagaaatctggtgggtgggtatttaaaatcatttttgcattagtttctctttcgtttgtattaggcggtattggtggtgggttgatggctacagacaattccgttgccaaagtcaatggagaagaaatttctcaacaagtatttagccgagcaaaaaatcagcagcaaaatatcctaaatgctcaattaggtgagcgtttttgggatttaatggacaatcctatttatgtcaaacagttccacgagagtattttaaatggtttagttgatgacgagcttcttcgtcaatacgctaagagccttaaaattgacgttagtgccgatcaaattaaatcagaaattgtaaacagtcctgctttccaacaagatggtaaatttaataataatttatatcagcaagcattacgtaataatggtttaacggctgatggttatgctgcaattgtttatgaaggcatgctatttgcacaaattcaagaggctattgtaaatagtagttttaccgttcctgcacaacaagaactattagcgaaattattgttacaaaaacgtcaagtacgtctggcgacctattcaattgcaaaagaggtgaacaatcaaaccgcttctacagaagaaatgcaagcctattatgaggcaaataaagcgaattttgttaatccagaaaaattgaccgtagaatatatttctattgaaccaaaggatttggctaataaaattcaagttactaacgaacaaattgacacttattatcaaacaaacaaagctaaatatacgacaaaaggcgaagcgaaaatcgcacatattcaagtagccactgaagctgaagcaaatgaaatcgtacaagcactcgctaaaggtgaggattttgcacaattagcaaaagcaaaatcacaagataaattatctgctgctcaaggtggagatttaggttgggcgaaagcgggcgtcttcccgaaagcctttgaagatgcggctaatatgttagacgctggaaaaacaagccaaccaatcaaggtagataatgctttccatattataaaagtattagaacgtaatgtagaaactgttgtgccgttagagaaagtaaaagctcaaattacggatacaattcgtaacgagttacttttaacggagtattcaaacatcacccgtgaaatggcaaacgtagcatttgaaaatagtggctcacttgaagcggttgcaaaagtagcgaatgttctagttcataaaacagatgctttcacacgtgaaactgtacctgctgaacttgataacgagaaagtcctacgcgttttattcgacagtgaagtgcgccaaaatgggcaaaattcagaagctattgatttaagtgatgccacaaatactaaaacgatgtttgttcgtgtaagtcactatcaagctgaaaacgtacaaacttttgacgaagcaaaatcagcagttgaacaagcagtgaaacaacaaaaagcgctcaaagtcttagaagagaaagccactacacaagttgcagcattgaataaaggcgaaacagtagaagtcgcatttggtgcctctgaagaacttgtctttgcacaggcacaaatcactgaaccggctttagcacaagcggtcttttcaatggcaaaacctgcagaaaaaccgacatatcagaccgctcgtaatacgaatggtgacgtggttgttatcgctttagataaagtgagcgatggcacagctgacgagtttaaacctttacaagcacagtttaaccaagcagagcgagttgtgttacgtaatgatttacttaaagatttgcgtgaacgtgcaaaaatagaagtaaatcaagacttccttgatcaactcgaaagcagtaaataatatgaatgtgaatttggttaaaaatttgtaattgactttatctataaatttccgcaaaattcacgtaaattttttaatcttcagggcagggtgaaattcccgatcggcagtaaagtctgcgagcggcggcgaaagccaaagcaggaactggtgaaattccagtaccgacagtgatagtctggatggaagaagagctagaatgtctacactcgaacactgttcgagtgcttttcttatgcttttaacgccttgagatcgtgagatttcaaggcgtttgttttttcctctcccgtttacgggagagggaggagccaattcggtagaatttgcggagggagagggtttgcaataaacttccctctctctgcttttcgtaaagccgttactttgctcaaagttgtctctctcccgtgaacgggagagaattattcttcttccttgcccttcaatttatgatttaaaacccaaaatgacacactctatttttatggctcgtgccattgaactggctgaacttggtcgtggctggacaaatcctaatccgttggttggttgtgtgattgtcaaggacggcaacattgttgcggaaggctatcaccaacgctacggcgaatggcacgccgaacgtaaggcgattttacattgtcaggaagatttaagcggagcaacggcttacgttacccttgagccttgctgtcaccacggacggacaccgccctgttctgatttgttgattgaacgggggattaaaaccgtcgttatcggctcaagtgaccccaatcctctcgtggcaggcaaaggtgtggcacaacttcgccaagcggggattgaagtgattgaaaatgtgatgaaagccgaatgtgatgcgttaaatccaattttctttcactatattcaaaccaaacgcccttatgtgttgatgaaatatgcgatgaccgcagacggtaaaattgccaccgcaacaggcgaggccaaatggatcacaggggagcaagccagagccaatgtgcaatgcacccgacatcaatacagtgcgattatggttggagtagataccgtgttggcggataacccgatgctcaatagccgaatgccaaatgccaaacagccagtacggattgtgtgcgatagccggttacgtacgccattagagtgtcaattagtccaaactgccaaaacctatcgcacgataattgcgacagtttcagacgatttgcaaaaaatcgcccaattccaaccgcttggggtggaagtactggtctgtaaagcaaaagacaagcggatcgatttagccgatcttttgcaaaaactcggcgaccaaggcattgacagcttattgttagaaggtggttcaagtttaaatttcagtgcgttaaacgctggcattgtaaaccgtgtgcattgttatatcgccccgaaattagtcggtggagttaccgccaaaacgcccatcggtggtgaagggatcggcgtgttggcaaatgcggtgcaattgaaaaatgcaaagatccgccaaatcggcgaagatcttctgattgattatgaagtaggaacacattgatatgttcacaggtattattgaagaagtcggcaaagtcgccaaaatccacaaacaaggggaatttgccgttttaaccatcacgggaagcaaaatttttacggatatgcacttaggcgacagcattgcggtcaatggtgtctgtctaaccgtaaccgaatttggtgcgaaccatttttccgcagatgtgatgtcggaaacactcgctcgtacatcattgggcgaattacaaccgaacagccccgttaatcttgaacgtgcaatggcggcaaacggacgtttcggcggacatattgtgtcggggcatattgatggcacaggggaaattgtcagcattacccctgcgaataattcggtctggtatcagattaaaaccacggcaaagctgatgcgttacatcattgaaaaaggctcaattacgattgacggaataagcctgacggtggttgattgtgatgaaaacagcttccgcgcatcgattattccgcataccttaagtgaaacgaatttaggcacgaaaaaagtcggtagtattgtgaatttagagaacgatgtaatcggaaaatatgtggaaaaattgctgtcgccgaaacagagcgagccacagagcaatatcaccgaagagtttttaaagcgagtggggttttaaatcccccttagcccccctttttcaaaggggggaattatcaaaaaggaaagcaaaaaattccagaatttaaagtagggacgccacgcttggcgtctgtaacaagcggtcagatttaaagaaaaggaaagcaaatgtttcaattttcaagcgtagaacaagccttagacgcattacgtcaaggcaaaattattatcgtcagcgatgatgaagacagagaaaacgaaggggattttatctgtgcggcggaatttgccacccctgaaaatatcaactttatggtaacttatggtaaaggtttgatttgtatgccgatttcaacggcgatagccaaaaagctcgacctaccgcagatggtttcttacaacaccgataaccacgaaactgcctttaccgttgctatcgatcacattgataccggcacaggcatttcggcttttgagcgttcgattacggcacttaaagtggtggacgacaacgccaaaccaagtgattttcgccgtccagggcatatgttccccctgcttgcaaaagacggtggcgtgttggtgcgtaacggacacacagaagcaacggtggatctggctcgtttagcagggcttaaacacgcagggctgtgttgtgaaattatggcagacgacggcacaatgatgaaaatgcctgaactacaagcctttgccacaaaacacaatatgccgtttatcacaatcgcccagcttcaagaataccgccgagcaaaagattgtttaattgagcagatttctgtggtcaaaatgcctaccaaatatggcgactttaccgcacatagttttatcgagaaaatcacaggcaaagaacacgttgccttagtgaaaggggatattggcaatggcgaagaggtgctgtgccgtattcactctgaatgtttaaccggcgatgcctttggttcacaacgttgcgactgcggtcagcaatttgccgctgcaatgagccaaattgagcaagagggtagaggcgtgttgctctatttacgtcaagaggggcgaggcattggcttaatcaataaactgcgtgcttatgagttgcaagataaaggaatggacaccgtcgaggcaaatttagctcttggcttcggtgaagatgaacgtgaataccatatcggtgcacagatgtttcgcagtttaggcgtaaaaacaatccgcttgctaaccaataacccagcgaaaatcgaggggttacagcaagttggcttaaatatcgtggcacgagaaccgattatggttgaaccgaataaacacgatttggaataccttaaagttaaacaagttaaaatgagacatctgtttaatttctaaacttgttaaatgacattcattttacggacacacgcagtgtgtccctacgacagttttatttttatatcaatttacattcaatataaggaaaagcaaaaatggcaattatcacaggtaatttagtggcaacagagttaaaattcggcattgtgtgtgcgagatttaacgattttatcaacgacaaactgttaagcggtgcgattgatacactcgttcgccacggtgcaagcgaaagcgatattgataccgcttgggtgccaggagcatttgaaattccgttggttgcgaaaaaaatggcggaaagcggtaagtatgatgcagtaatctgcttaggcacagtaatccgtggctcaaccacgcactatgattatgtgtgtaacgaagccgcaaaaggcattggtgcggtgagcgtacaaaccggtgttcccgttattttcggcgtattaaccactgaaaatatcgaacaagctatcgaacgtgcaggcacaaaagctggcaataaaggctcagaatgtgcgttaggtgcgattgaaatggtgaatgtgttgaagggactttgatatttttattcactagagccttctccttttatggtcacattatggcgatcgcataggcgatcgccaaataacacaataaactactttggataatacaatttaccttcgccatataaaaagagtttataacaacaacccatcatcactcaatttctcgtgacgactttgctcaaacaaacgtaataaatctggtacgtccattttcttacgggtgtcgcctgccacatcaaaagccacctgaccttgatgcaacattacagttctatccccataatctagggcttgtcgcattgagtgcgtcaccattaacgtagtgagtttttgctttctaacaattttattcgttaattctaacacgaaagcggtcgttttcgggtcaagtgctgcagtatgttcatcaagcagtaaaatatttgaaggttgcaacgatgccattaataaactaaccgcttggcgttgcccccctgataatctgcccatttggtcagtcagacgattctccaagtctaatccaagtaaggataatttctctttgaacagctctctgacttggcggttcagtgcaaaacctaaccctcgtttttgacctctttgataggctaaagccatattttcttcaatggttaaggcttcgcaagttcctgtcattggatcttggaaaacacgggcaacttgcttagctctttgccagctagtcaatttactgacttctttaccttgaataaaaatctcaccgctatctattggataatcgccactgatgacattaagtaaggtcgattttcctgctccgttactgccaatcaccgatacaaattccccttcggcaacattcaggctcaatcctcgtagtacaggattttcaatcacagtgcctttattgaacgtaataaatagattattcaactcaatcattatcgacctctttttgcagtgaatttgtgcttgaatttaggtaacgcaagaaccgctacaactaataatgccgtgattaaattaagatcttgaggcccaaaaccgataccattgagcgtttcattatttaaggctaatgcaatgaaaaagcgataaagaatagaaccaataatcaccgctgcagttagacaaataatacgttttgcagagaaaatcgcttcaccgataatcactgcagcaagcccaatcacgatggtaccgaccccaatcgaaatatcaaagccaccgttactttgtacataaagcgatcctgctaatgcgattagcccgttagagatagccataccaagcaaggtcatcttattaattgcaataccttgtgcttttgccatacgaggatttgtccctgttgcacgcacagctaaaccaatttgtgttgcaaagaaaagatcgaaaatcaacttagcaataatcaccacaaaaattgccattaacaaccgcaccattgctaactgaacatcatcttgagcggtcattacatcataaatcgtcgcttcacctaacaaagaaacattaggcgatcccataattcgcaaattgatcgaataaagtgcaatcatcatcaaaatactggctaacagtttttcgattttaaaaccaatatgcagacttgccgtaatcatacctgcaaccgcaccagcaaacattccgcacaacgtagcaatccaaggatcgatatgatgcaaaatgcaaagcacacagacaccgccacctaaaggaaaagagccatcagcggttaagtctgggaaatctagaattttgtacgaaatcagcccccctagagcaactaaagcataaatcaagcccagctctaaagcccctatccaagtaacattggtgaaataagtcgtcaaaaattgaagtaaggaatccatcttaaaaatactattttactagtacaacaatgtttcgcattgtacgctatttcagataaaaaaacagtaaaaaaatagatttttgtaaatttttttcacgcaaacctttgcttttcaatgggttgccgacaagagaaaaaataagcggtagaataagcagtagatttttcaaataatagaggatacaaataaaatgaacgcaatcgaaattttaggctatgttgcaatgattttagtcgcaggttctttcttattaaaagacgtagtaaaacttcgtttagtgaatgcacttggtgctgtatgtttcgtgatttatggtattttgattaattcattccctgtaacaggattaaatatctttgtggtgtgtgtgaatgggtattatatttggaagagtcgctgttccaaataaagagttcatttagaattgctaaataataggcatttgatttcataagtaatcagatgcctatttatgtagagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgacggcacctttgaaccgcaacttatcaagaaaaaccaaacccgcatcacaggaatggatgagcagattattgccttatattccaaagggttaagtaatcaggaaatcgttgaaatgttcaaagaactctatgatgcggatgtgtcaagcagcctgatttctcgcgttaccgacgccgtgaaagaacgcgtaatggcatggcaaaatcgcccacttgatgcggtttatccaattgtttacctagattgtatcgtagtttcagctttgcattgtgcatttagtgcgtaacagcgtgaaattcgtttcgtggaaagattacaaagccgtcactgcagatttaaagcaggtttatcaagccccgacggaagtacaagctcgcgaaaatctgaccgcactttcgcaaaaatggcaggcaaaatacccgcttgtggcgaaaggctgggaagataactgggcaaatattgctatattttttgattatccggctgatattcgtaaagcgatttataccacgaatgctgtggaatcgcttaatagcgtgattcgtcgcgtgattaaaaaacgaaatgtattcccgacggatgattccgttttcaaagtgatttggcttgcgattaaagatgcaccaaaaaaatggacaatgccgattcagaactggaaactggcgatgaatcgatttatgattgattttggtgatcgcctagacgatcaccgttaagttgaaatgggtgtttacacagaatttgggatagggtctttatgtatagtaaagagtcattcatgtagagctcttctagagttctatattttcaatgttgctgacctaatatcacaaagccaatgcggcgccgttgtgcgatgcaagattttaaacgatgagcttgcaaaattcggcgatatttactgatagttaagcgtttaacacgctgtttcaatttacgttttatcataaatactccttatttactctatttttaattgatttttatgatttcctgtgtgttatttgagtttgatatttcttgctctttcactctctgatgattgatcaagctattgtaataacgtcggatattttctacatattgaaaggcttcaaatccacgagcatatccgtattttagttgagtatagtaatgttttttagcaagtagaggcaaatttttctttacatcaagccaattatctggatttcctccaagttgtttagttaaacgccgcacatcaatcaaatgtcccattcccatattatatgccaccaagctaaaccaaatacgatcttccgatgcaatactttgaggtagctgattcattaataaatgtagatattctgaaccagctttaatactttgttcaggattaatacgatctgttacattcatcctttctgcggtatctttagtgagcatcattatgcctctcacccctgttggtgatgttgccgtaggatcccaatgagactcttgataagcaatggccgcaagcatctgccattctaatattcctcggtatttttcaaataaatgtaaatatttaggcaaaacagtgtcgatagcttttaaatagctttggctatccacgtagtcaaagcgatttaaataattgaaatatttttcctcaattcttgctattaagcctgtttcattcgcattatccataaaacttaatacggcagcttgcagttcactatacccgctattttgtaaataccatacaacaggctcctcatcggttaaatcaaatccaacggcaacatcaggtttaatatgttgtgcagctgagacatcaatagacacggctacagtataaggaattttgccatcggctacttgtattaataattcctcttgagtgaaattgtctgttactttccatttcaatgaggggtactgttcttgcaatgttgttaaaattggaataacagctgaacctgcagggattagtaattcatcttttaaatcaccaatgctgtaagggcgctgacttccttttttatacacaatctgccatgaggcagaataataacttggaccaatttggaatttatctgcattttctaattgatatagcaatcctgcagcggcaatatcaatttcattgagtttcaaaccattaaataattgttcgctattattgtagtttttaacttctaacccgacacctaaatattcagaaaacgctttagcaagctcatattctatccctgcggttccttctgctccctcaaaataagagatggggtgattaatcattcccaccttcagtattttacgttgttggatctgcgtataacgattttcttctgcctgcattgcttgttgccaaggaaataccatatcccatgcccacagcaataatgcaatcccacatgcaattctgatagctaagcctttcaatttctcctctctaaccttcactctcaacagagtgctgtagtttagcaaatctattatgagttcaatatgaatatattcttaataaatcaatttagtttaaccagtattcccagtttgaaaagaggaattaggggttgatatgtcgttgataagctagaagcgtattttgcattaacatagcaacggtcattggtccaacaccacctggtactggagtaatgaattttgccttttgggaagccacttcatattcaacatctcctaccaattttccctcaatacgattaatgcccacatcaatcactatggcattttctttaatccattccccaggaattaaattaggctttccaactgcgactactaataaatcggcttggcgtacatgattttctagattctttgtaaaacgatgagtgacagtgacagtacagcctcctagtaatagttccaatgccattggacgcccaacaatattggatgctccaacgataacggcatgttttccataaagattctcccctgttgtttctaagagcttcattacaccataaggggtacaagctcttaatgttggaatacgttggcataaacgcccaacattatagggatgaaaaccatcgacatctttatctggagagatggcttcaatgatttttgttgtatcaacatgctcgggaagagggagctgaactaaaataccatcaattttttcatcattgtttaatttgttgattaaagagagcagttgtgtttccgttgtgtctgcaggtaaatcataagattcagaataaattcctaattccgcacacgttttacgtttactcccaacatatacctgtgaagcgggatctgagccaacgagaatgacggctaaaccaggagcacggtatccttgttgcacgtaagacgcaatgtgttcaaaaatttgagttttaatttgttgtgcaagtttattacccgaaataatttgtgcggacatgactaattttccctatgtaattgacagtatacattcggtattctctcaaaaaaattgctttttagtaagcattaatcttgaagatgtttaaagaacgaacatttaattgcaattacttaaaaacttattgaccttaataataaaatttttataataggacgcacttttcaggacaagacggcgagtagcgcagcttggtagcgcaactggtttgggaccagtgggtcgtaggttcaaatcctatctcgccgaccattctatcgttttcaaactactatcttatcatagtgcaatgcgcccttagctcagctggatagagcaacgcccttctaaggcgtgggtcaaaggttcgaatcctttagggcgtgccattatattcttttaaaatcaatcacttataagctatgcaactaatcttaatctgggctcattttgcgaatgttccgtaaatgtaccgtaaatttcgaccttgtttgcgtgttccaataagtgttctgcatttaaatgagcatactttttaaccatttctaaggtttcccagccgcctaattcttttaatgtgaaaagtggtgttcctgcttgaacgtgccaactcgcccaagtgtggcggagatcgtgaaagtggaaatcagataataagcatttttttgtagataaattaaatgcttttcggttaatatcctgtaaaggattaccgtttctgcccacaaatacatatttagaatggcggtggcggatagattcaagaagttttatggcttcttggtttaataatagcgatcgtgccttacctgactttgcaacatcattagtcacgattgctactttcctttcaaaatctatcttatcccaagtcattgttaaaatttctgtccgtcttgctcctgtcatcaaagcaaatttgcagatagacttcatccagtcggaactcaatttatctatgagctgttttgcttgctgtttcgtgatccaacgcactcgaattggcggttctttctttttctgtatatatggcacagaatccagcataccgagcttatgagcgatatttaatactctcaataaagatttcacatacttgttttgcgtactatgagataatgggttcttagtattcgcattcttttttgggatatttaagataatttcttgtgctgttaaagagctgagctctcgccctgcgaatttagagagccagtattctgcgtgtcgctttttcgtggctttatcctttaattcttcagcggaacggacataatgtaataaagcatcttcgaagatgtattttctctttgtttcgagcttatcttctgcccacatttcttgcttgagtttgtcgtgatactgctgtgcttcacgttttacaagcgtgcgagtgcttctcttaattctcttgccgtttggggttgtgatatcaacccaccacggaccgtttgcttttcgtctgtagatcgacattttcttttctcctcgaccgacagagataccccacggtcattattcgcttgtttttttactcggtcaagatctgatcgtttaacccgccaaactttagatcctgccattttaaaaaatccccaatctgctaggtgctggcggacggtatttgggtggcaatttaactctttggcgacttggttaattgttaaatgttctatgtgtgtcattctttttacccaataaaaaacctagctttcgctaggcttgttcgttgatccataaaataaaaccgcccataaagagcagttggttgtggttaaaagtttgctaatcgttgttgattaagctggggtagggcttgttcaatgaatgggtcaagccacacgttaaactcgtgtgcgatgtcgtagcctttccctgcgatgtcatttctaacataacgtggaatacctaaatcttcgtatagtttacggtggaatacttctacttcttttgcaaaggctcttgctcttgctaggtatttggcaatttgttctgcatctaaacctgtaatggtgatgtcttttttactgcggtcaatcggacgatattgattgccgagtgtgtttaagaagttgataacgtgttcaaacattgtttgcggtagttggtcatacttcgctacgttaaaagtgcttttgagccgagagtagatttcttgccagtgtaatcctgttcgatagtgagcctgttgtaccgcttcctgtatagctcgttgttgctcaggggtgattgtaagcggtgcgatttgttgttcattttgcgaaatttcacgatcaagaatatccagcacccatttgcgaaaatctttggcgactttggtgcgggcgaacattgcgataaggtgagctccacgcaaagagaagacgcgaacttgttgttttccgcctgcggtttgcagttcgataagtgcggtcatttctgcggtaaattcgtctgcgttgcggtcgtagatttttacgattgcttttgtaggatcagcgtattctaatgctgtacctaaatcgtttgctgttaagaatgtgtggttgtttttattgataaccgaaagagtagtgttttgaaatgttaatgtagtcattttattgttccttgtgtttgttttaaaactcatcacaagctactgcaataactggtgatgaactggctaaggtttgcagtaaccgttacacaaggaagacggcagatctttcgatctccttaaccagcccatcattgactactttaaaagggttccccaatttggggctacctttgaaaagtttgatttgactagatttcggctataaaaaaatcgccattaggcgactatcattattaccgccacttattctttcaggactgcgattccgactttctgttgaaagtggggtatcttaaattaaagggcggtgggtgtcaatactagataaaacaaaggggagccttttagctccccacttcacgattaagttagcttgttatcgctttgcttaatcgaccaaacatttttcagcttggttttacaagcccctttcgggttcactgttaatttaacttaactttaaggctttagcaactgcttttttgatatttgcaaaatcttcatcatcgatcacaggtacgacatattcacgtttttttagcttataacgatctaatcttgataatgatactgtataaaccatatcacatttagcccaacattgaatattgcttttatcaggtaacgggttattaggcattgggtagtgatagggctctaatggctccggtttggtagtacttaatggcacaatggtaaccaattcgctatttttcttgtgctttgatataacgacaacaggacgagttttcaccatttcaggggcaataaaacccgaaaaatcgcacattacaacggctttttctttaggttgatattttaatgccattttaaaatccttgtaataaaaaagccgtaaaatacggcttgaaagtgcggttatcttaatcctaattggcggtgggtgtcaatatcaataaattatataaataatacttgtattttgtttttattatttatataatgaacttgttttcggaatggttctgaaaatgagaagcccgactgaaatcgggcatttaaaaaaggagctaggattatgttttggaaaatcgcaatcctagttatcttgttagtggtaagctcaaatgcttactagttaatggataaccctgcgggggatatgtgagagtgtcccccaacggctcctaatataacaacttcagttttaaaaatcaaccaaaggtaataaaaatggcaaacgctcaaacagaacattctcgtaaacttcgtgcggaaacttcacgccgattaaatgataaagccttagcggaaggtaaggcacgccgtattttaatgcaattatcttcggaagttgccgatgaatttgatgccatttgtgctgaaatgggtgtttctcgtccacaggcgatcaaggctttatgtgcgttgtatcgggggaagtaggggaggttttttctcctgttaaaaattaaacccctgcccgtgtgttacgactttttcgatttcttcgtagcggcggacgttaaatttctcaaactctaatactttgactaggctttctgctttagccttgagttgttcgagttcttgctgttgtttgaaattctgtgcgacaagttctgaaatgtgttcgtttgctcgaataacggcaagggcttgccgtgagcagagtgttacataatagtttaactgcttacgcagtttgaaaggattgagggttttcatagtggttcctttggtcaatcgagttagttaagaattctactttgagcaacttcgatcagtagtttgtattcgtgatgggtcttgtcatcgtggacttcttttgattttgataaaaactcgtccaccgtgcctgtaaagcaaccacgagtaacaattaacccaaattttccattaaagaccgtaagcgttccattttctgagcctacattacttgcccaaaaaatcattttgcgttcagagataactgcaaaagatctcacccgagcatcaccgaacacccgagcgatatcgtacacccgagcatcaccgcacaccccagcgttaccgtacacgcaagcgtcaccgtacacccgagcatcaccgaacacccgagcattaccgtacacccgagcattaccatacacccgagcattaccgtacacctgagcattatcgtacacccgagcattaccatacaccccagcgttaccgaacacccaagcattaccatacaccccagcgttaccgaacacccgagcattaccgtacaccatagcattatcgtacacccaagcattaccgctatgatctaaattcttttcggtttcgatataaccgcctaattggcctgctccaactaaaccaaatgtaataagtgctttaattcgatagagcgttctgccgaaatgttctactgtgtcatctttgagtagttcgtatttcttttgtgtagtttgttctgtcatttttaatttccttgcaataaaaaaccgcctgtattgctacaagcggttggttttcgtgaaaatgttgcaataaaaaagccaccgtaaaaacgatggcttagtgaaataatgcttgatttagttagataactaacttataataactttgttttcagtaataatgctgaaaacgagctgggtctgacctttaatctacccaactttgaagaggataatcaaatgtttaaatacattatcctagttatcatcttgttagtacttagctcgccagcttactaatttgatgataatttaacgagagggagaaatctctctcgttcttcaaaactaatgttaaggatttattatggcgatgtcaagaaccgaaattgttaaacgcagtgaggaaaaacacggtattaaactcaaagccttcaaacttcctttagttgtgattgctgaaattgagcagttaagtacagagttaaatattccacaaaatcagttgattattcaagccgttgagctgtttaagcaatcgcagaaaggggcgtaatgccctttattaaaacgccctcaaaactaagggcgttgccattaattcactttcaacgccttcagcgtttcaataaattgcggaatgtacttatcaaaggctttcatcaacacaggatcggggttttcggtgtggataaaaagcgtttgtttttgatattcagggcagtagctgacaaaatcccaactgtcataacccgtaacccataaggcgacttgtacctgtatgatgtactcgctgggtaccacgccctcaatgatatatttgatgtgggttttcattttggggcatttgatttctaagccttttcgtaaggttgggataagtccatcggggcttaccatcatatctttgtcggcattgcgatatacaccaccaacctgaacaacatcattgcctgtggcgaactcatacgccattcttgcttgttcttcaagctgattacctcgcaacatatcgctggatttaaagccttctgttaagccctcaatgctttctgcgaccagttcggcaaggtagcttgtccacgcacttgattttttaccgcttggggtgacgatatttgacacccctgttgcagtaggaatacctaatcgtgcggtgagccattcttctgtgccttgctcacagttgagtgtgattaggttttctatcataacggtatattttcccctaggttttcgctttgtgcatgtgatttatcaacacgctcattcaagattttgattaaatgttcagctttgtctttcggtagttgatcaaggctgtttacaccatagtacgcaatagctttggcgacatcggtttgtgtaatttggataagttgatcgagttgttggcgttgttcatcagtgatcctaacaacgccatctacatcgattacggtttgttgtggtgaagctggattaataggctcttcagttatctcatcagcagtgattacaccgcccaattcatcaggaaatgctttacgcaatgcacccgcttcagcacatttagcaagctgccctcgagggcgtttcgtccacattgaattaactttatattttcctgttcgttgtttgccttcccatatttctgttattgcacaggcttcagtaaaatactcagtatgagaaaatgcacagcgttcaccattaacaaaacgataaacagttactttgcaccattcaggagcattcacaccaagatattctatagtatcgccaaatacaggatcatcttgccctgccatttgcccggtacgaaatgctgtaattcgttgttcataaatacccggcataattacatcacgccattctttttctgctgtttttgcatccgttacgttcattggtacaatatgacaaggtttcttgagaatatccattttacgagccttgcaataatcaatcgcaagtaaaatactttcgtctttcgcaccagggaaaatgctgttttgtaatgtactccatactgcgtggtctatgccacgttcagaaagtgcggtttgaatgttggatggtaagtttgttgtcataatttatccttattttgctttattaagtgaaacacaatccccaaacttcgctttaagctcacgagcaatattaacagcgtgggattgaatggtttgatttaatcgaatggttatcacaaaatcccctaaaggctctgtggtttccgtttttgcaaaatcctgtggattttcgaccgcttgttgctgtgccatttcatctgcaatagcttttgcctccgcttgaactttttccgcctcagcttttgctttagcctcttgttctgccttggctttaatttccgcctctctctgttcttcttcggcaatgcgttgctgaatgattggctctaactcttcttcccctgcaatcaacactaaccagtctttaaacaggtattcgtaatgaataggaattagctttctgcgtgcggaaattcgagctgcctccgctccgacttctgcggtaattgcggtttcttcggcgttcaccgcacttgttaaagttgccagtgtacttctacgcttggttgcttcttcaaggcgttttttgatattttcctttggaatattacgctcaagggcaagcgatacatcgctttcgtgactgcctttgattgttaaaattgaccctatcccaaatacacccatttcaacttaacggtgatcgtctaggcgatcatcaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccggataatcaaaaaatgtggcaatatttgcccagttatcttcccagcccttcgccacaagcgggtattttgtctgccatttttgcgaaagtgcggtcagattttcgcgagcctgtgcttccgtcggggcttgataaacctgctttaaatctgcggtgacggctttgtaatctttccacgaaacgaatttcaagctgttacgcactaaatgcacaatgcaaagctgaatcttcgttttaggatagactgcattgatggcttccgggaagccttttaaaccgtctacacaggcaataaaaatgtctttcaagcctcgattttgaagctctgtcagcacattcgcccagaacttcacaccttcattttcagcaatccaatcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttccggtgtttttagatttttggcaaattccgctgccaaggcgtgaagttgtttttcgttcataataaaatacctgtgtctgaatgtattatctcagaaacaggtatttacacaaattgtgggagaggctccattgatgatattttgaatgtttgggttcgtcgctgggcttctcatcgtgggtgccgtggttatccatcattacaatcctttatgcctgaggcgactgctcaaattaccaagtatagtattgatgaactgtcagaggagcattatcttaagctagatgaagctgtgatgacgttacacgatttgaacttagaagcctatcaggtgttaatggcggtgtttttacaggggcaagacaagaagaatatttgtcttgagatgcatatttcaccgagaacgtttgacagacgactacgcacagctcgagattttatggaaggagcggtatttggttcggggttgattagattgaagttttaggcgtattgctacgcctatccattaaacctgttgagcggttaattcacgttgagaagcaactgctaaaaaatggcttctatctcgataaaaattactatgtgagacacgattgtcaattctgtctaatagatattgtggtaacacaatgtttacccgttgctttttacctaagaatgcagaaatatctatatcaacaagcaaccaactatcacagtgggaaaaatcttcttgttgtttgtagtggacaaatcccttatcttgaagcgtactaatatcaaactcatcttctaccatcatttctaacattgtatgaatggcatcttttacgttagggataatttcatcaattgcatcggccgcactaaagcaactatattcatcagtaaatagtgcaggtacacaaagtccaaatgcttcgttctcattatgtggagtttctaccccaacggtaaataacataattctctcctttgctaagctcggcagagctataacagccctgccgattttttgatggaacgtgaagtgccaataggtaaatcttgtttagggtgtggtacaggaaatcgctttcctgtaatcggcgattgccatatttggtgatcgccttttccgtgcctaacaaagaaacaacccgcctcttttagttccttgattaagtcgcttgagtgcatgcttcctcctttgtcttaatcaataataattatatacacataaatacacacaatcaagcatttaatatttaagaaactatatggggtttaattgctcaaaaagtgattgactggtggcgaagaaagttgtatatttcagctacgcttgcaactcgtacaagcgagataaagcaaaatgattttgtagccctgagcagaaatgcttggggcttttttattgcctgaaacgagggctaaggtatgaaaaatgttatgagagatatgggaacacagacgtatatttggtctggatttagtgggattattgcgtggttgagtgagcaacagaatttaatgattttaagtcttgcgattggtattgtgacggcgtgtgcgaacttgtatcaacgctgtgacgaaggtaaggcgaagcgtcgtgaacgtgagcgagccgaagaagctcatcaaatcagaatgcagatttatcgggtaagggcagagaggttaagtaatgagcaagctaaaaacactaggtaaagttggcggtggggtttgttttgtcagtgccattattgcggtgttgaatacagattttcacggtcaatttcgtacaagtcagcaagggcttgagattatcggcgatgcagaaggttgtaaacgtgagccttatttgtgtcctgcaaatgtgcttactgttggtattggttcaacggaagcgtcaagcggtaagattgaaagaaaagtttacacggacaaagagattgcagaacggtggttggttgatattcagcacgcagaaaaatgcgtgaaccgttacgcaaatggtggtgatattccgcaatcggtgtttgatgttgctacttcgctgacgtttaatgctgggtgtggcaccgtgagtaaatcgacgttctttcgtaaaatcaaatcaggcgattatgttggtgcctgtaatgagttgcctaaatgggtttattcaggtggcaagaagttacgagggttagaaatccgtcgtgagaaagagaaggcgttatgtttagctgggttaataaaatcttaatggcattgattttgggcttgtgtgcgtggctatggggtcagtcacagaggataagtgcattaacagccgagaaccagacgcaagcccaaactattgagcaacagcaaaaagcaaacaataagctgacaatgcaactgcaacaagagcgacaagcggtggaataccagcaaaatgttgcaaataaactgcgaaagcaggtggagcagagtaatgaacagattaaagctattttacagaaagagccgtgcggcgttactgctttgcctcgtcctgttgtcgatgagcttaagcggttgcacagcaaagacaaagattgagtatttatatcctccgcaagcctttttagtgccgtgtgagcggtcagagtttggtggcacaacctatggtgatgctattgagtatctcgttaaggtgatgggagaacgtgacttatgtgcgggtcaggttgatagcattagagagtggcaagcacgaactaagcaagggtttaaatagctgattagtgtttgtgtcacgatagagagcggtcagatgatcgctcttttattttatgtaaatcaaatgctacataatttgcgtatggttttggggttgttggataaattcccgagaaaatacgcaagtgatgtaatttatatataacaaaaccccgatcactgcaaatgatcggggtttttcattacccattaaagccgaatgagtaacgatttatggagattatgacagttttaaccgtaaccatcaaggagatacttatggaatatggtttatggcaaataagccttgcagtaacactacctattttagcgtttgtttcaccaaagctaattaatgccattgctaatttattgaatgttttgaaataaaaaggattaaccacgatgacgaagaaagacgaggttaaatccacgtctaaaggtcgtgggttaacacctaagcaagaaaaattctgccagctttatattgagcttggcaatgcgagtgaggcttatcggcaggcttacgattgttcaaaaatgagtaatgaaacaatcaatacgaaagctaaagaactactgaagaacggtccgattacggtccgattggatgagttaagaagttctcatcaacaacgtcataacattaccgttgataacttgttaggcaagctagagcgtatctataacgaggcgatggagcgtgatacccctcaattctcatctgcggtaaatgcggtaatgggacaagctaaacttttaggctttgacaaacaggttatcgatcatacaaactctgacggctcacttcgccctacggttattgagttggtggcaccaaatgaaaatacagcttaatcttcctcctaaactgataccggtgtttacacagcagaatgtgcgttatcgtggtgcttatggtggtcgtggttcggcaaaaacacgcacttttgccaagatgactgcggttgttgcatatcaacgggcaatgcaaggcgaaagcggtgtgattttatgcggtcgtgagtttatgaactcgttggaagattcatcattagaagagattaagcaagccattcaaagtgaaccgtggttagcaaatttttttgatgttggtgagaaatatgtacgcacaaagtgcggtcgaatttcctatatttttacaggtttacggcacaatcttgacagtattaaatcaaaagcacggattttacttgcgtggattgatgaagcagaaagcgtgagcgaaatggcttggcggaaacttctgcctacggtgcgtgaaaacggttcggaaatttggttaacgtggaaccctgaaaagaaaggttcggcaacggatttacgctttaggcaacatcaagacgaaagtatggcgattgttgagatgaattatagcgataatccgtggtttcctgatgtattagagcaagaacgcttaagggataaagcccgtttagatgatgcgacttatcgttggatttgggagggggattatcttgaagaaagcgaggctcaagtctttagaggaaaataccaagagcttgagtttaagcctttacctgattttgaaggtccttatcacgggttggatttcggttttgctcacgacccaaccgcagcgattaaatgctgggtgtttaatgatgaattgtatattgaatatgaggctggcaaagttgggttaagagcttgatgatacagccacatttttgcagaaaggtattgctggcattgagcagtatgtgatacgagcagattcagcaagacctgagtctatcagctatttaaagcgacacggcttgcctcgtattgatggcgtttcaaaatggaaagggagtgttgaagatgggattgctcatattaaatcctataagaaaatctacattcacccacgctgtcagcaaaccttgaatgaatttcgtttgtatagctataaaaccgaccgcttgtctggcgatgtgttgccaacattagttgatgcccataaccactatattgatgcgttgcggtatgcgcttaatcctcgtattcagcggaaaggggattttagccaaaatccacttaaactttactaaggataatttatgtctgatgtttctattgttatgcgtgaaatcagggcgttgaatgaaaaaggtgtgatgattgatgatttgcttggcggaacaaaaacaatgcgacaagcagggaaaaaatacctttatcaattcagtcttgaggaagaagaggcttataaaaacagacttaaccgctcaacgctttatcctgctttatcggaaacgctctaccaaatgacaggtagagttttttttgagccgattacgacaaataacgttcacgataaattaaagcaagatattttgcctgatgtggatttagagggaaataatgtcgatgtattttcttctcgttggtttaatgcaggtttaacttacggcgtggcatggtgcttggtggattacactcgtactgagaatgttcgtaccattgccgatgagaaagccgttaatgctcgtccttattttattttgattaagcctaaaaatgttttgggatttaaaacggataaaatcaaagggaaacgacaaatcacgcagtttcgctatatggaagatgttgcggtagatgatggcgaatttggcacgaagattgagaagattatttatgtgtatgaaatcggtcgtatgcgtaagtacaaaaaggcagatggtcaatggacgctgattgatgatgtgcaacttctggctcaaaatcgaccgcttgaaattgtgcctgttgtaccgtttattacgaaagaaagtggagtgcttgcgttaggcgaaccaccgttgcttgaattggcttatctgaatattaagcactggcaatcacaatccgatcaggacaacattttaaataccgctcgtgtgccgttattagggattttctccgatactgaagtcaataagctacaagttggtggcagtgcgttacatttacccgcaggttctcaggttgcttatatcgaacattcaggtaatgcgattaacgcagggcaagagagtttgaaagagttggaaagccaaatgcgtgttgccggggcgaaactcttagataaaaccgtgttagcaatgacagacagtcaagccaaagaagagcaaggcaaagaaatcagtttattgcgactgtatgcgaataaatttgaagatgcgttagatttagccttggaatatgttgggttgtggttgggtattgatgatgtcggtaaggtggaaattagcggtaacattgatgacgatctcgatccaaatgcctcgatggatatggtcattaaaatgcaacaagcaggcacactttcaaaacaaaccgtctttaatgaggcgaaacgtcgtgggttgattagcgataatgtggaatgggaagatgaacaggctcgcttaaatgaagaaggggtagattatggccttgagttcgcaggacaaaccgaaacaaagcctgaatagtcgtattgcatacgcattaactgatcgcaaaattctgcattttcgttatgatgcacatcttagacagcaggtaatgaaacggctaagtaaaacacaacgtgagttgctcaatcgtttagcggccgcaggtgtggatgctttacctaaaaaagcaattagacacactgcttaaggagcttaagcaagaagtggcaaaagtctatcaagaaatgaccgcttacacgcaagacgagttaagcggttttttcacggcggaaacccaacatattcatcagctttacaatgatgaagtcggctttgatttttttaatcaggtgcctgaatataagcaaaaagcgaataaaaccgcaacgattattgcaggttcgcctttagaagactggtgggcaaagcaaggcaatgattttgcctttaagtttgagggaattattcgccaagggttgttagatggtcaacaaacaagtcaaatgattagtgatgttaagcatttaatgaatacgtctcgcagacacgctgaaaccttagtgattactgcggtagcgaaagtggcagataatgctcatcaagccttaagagatgaaaaccttgatattttggcaggagaaaaacacctttctacattagacactcgaacatcaaccgtatgtcaattaagagatgggttaatgtgggatttagataaaaagccgatagaccacgatgtaccttatcaacgaccgcctttgcacccacgttgccgcagtattttacagcttgtaaccaagagctggaaagagcttgggattgatggtgtagatgaaatgccatcaagcacgagagcaagccaagatggccctgtatcagagcagattaactacgaaaattggttgaaaagcaaatcgcctgagcaacaagatcaggtattgggcaaaggtaaggcggatttatggcgtagaggcgtgattacttttgcggatatgttggatcagagtgggagaccgttgactttggcaaatttaaatgcaaaatttaatactcaagatggagtaataaaacaaatgcgttcaaattggtcagacgattttcccgatacagttatagatagaaaattaggtgatgcaacatctcaccctctttatgaattagccaagagaggggatattgatgcggcttaccatttggcaaaagatcttgtttcagatgaagcaattgagaaattgcgtaaaatcatcgctggtcggaatgttattattgttccagttcacgctgaagaagctgttggtagaaatatgattcctgtagcaactgctacagtgctagcgaagaaattgaatgtaaaagtcgatctttccattgttcaagcaactaaggtttctagaacagcaggtgatggttggcatagattgatttattcccctgcatttgatggagaatatcctaaaggtcaactggctattattctcgatgatactcaaacgcaaggcggtacattagccagccttaaagggtatattgagcaacaaaatggcaaagttgttggtgcttatgctttgacaggaaaacaatattctgtacaattacgactatctaaagaaacactgaatcaattgagggaaaagtatggcagtattgaatattggtggacggcagaatttggctatgacttctcaaaactcacagaatgggaagcgagatttatcctcaattcacgtaagacagctgacgaagtcagaaatacaatcattgcgagaaagcaagcgtgaagcctatgaaagaatgatgaaattagattaagcactaggtattaatgcttatttctaaaccaaacaatttttctactaacctagcctaagtgctaggtttttttatacctaaatttcaactaaaccgcttatacagcaatgtgtaagcggttttttattgcctgtaagatagaaaagtacactcgacaagtagcgtttgtgtctcccactcgctatttcttacaggtttctttttagtgggaagaaactaggaggcatttatgcaagcattaaaagcaaaattctttggttcagaaattttagtcatcaatcataacagcaagccttatgtgccgatgaaacagattgtagaaaatatcggtttagtctggcacgcacaattcgagcgattacagcgcaatgaggttctttcgcaaggtattcgtgttatacgaataccttcaaatggtggtgaacaagaagcggtttgtttaccattgcactatctcaatgggtggctatttggggtcaaagtttccaaagttaagccagaattaaaagagaaacttattcgttatcaaaaagaatgttatgaagtgctttgggattactggactacgggcgtagcgaagtgggatgaaattcgacaacggcgagaagttctagaagaaaatgaaaacgcatcaaaaaaacgcgcaagcgaagcaggacgagcattacaaaaacgaaaattagaaaagcatacttatgaaattggtatagcacggctagatagaatggaacagttattacttgatatttaaggtgtgattataacgattgcaccttttttattacctgaaacctaaccgcactttcgcaagatcgtgcggtttttattatccacgtttcggaagaaacacaaacttacttaggaaggaaatccaaatgaaattaaaacttgatgaaaaaggcaatgttgtggttgtagatggtaaacctgtgtatacccacgaatgacgggaaggaaatcccttttgatgcaccgcaagcaatgcaaaaaaatttcttcgctcaatgctgaaaacaaacaacaccgtgaggctaaagaaaaagcggaagcagaactcaaaaagtttgacggaattgatgatgtggcaaaagcaaaagaggccttaaaaacggtggaaaatcttgatgctaaaaaactgattgatgcaggtgaagcggaaaaggttaaacaagaagtgattaagggctatgagcaaaaactggcagatgccaaagcgttagcagagaaagtacaagggcagttacatactgagttaattggaggttcgtttgctcgctctaagtttgtcacagagaaattggcaatgcctgttgatgtggctcaagcgttctttggtaagcattttagcattgatgaaaacggtgcaattttggcaaaagatgcgcttggcaacgaaattttcagtcgagtgaaaccagggcaacgtgcggattttgaagaggcgttagaggctttagtggatgcttaccctaacaaagattctattctaaaaggctctggctcaagcggtggtggcggtggtgctggctctcccgctggcaaacaatttaaacgtagccaaatgaacccctgaagagatgaacaagtttattcaggaacacggtcgtgaggcatatcttaatctacctaaagaataaaggaaaacattatggcaacaggcttaaacaaagatgtgattatctacaatgaactggctcaaactgcatatttagagcgtattcaagataatcttaatgtatttaatgctgcttcaaacggctgcattttattgcaagatgagaatatccaaggcgattttcgcaaacaatctttttacaaaatcggtggttctttggaacatcgtgatgtaaatagtaatggcgcggttgagaataaaaccattgcgatgggtgaaatggttggcgtgaaaattccgtttaaatacggcccttatgcaattacggaagaggcaatgaaacgccgagcgagaagcacggaggagttttctatccttattggccaagactatgcggatgcattattagacggttattttaaatacttgactgctggtgcaatggcggcaattgggacgaatggtgatatgaaagcctcggcgtctattgcaaccgatcacaaaaaagtattgaccaaagggatgcgtaagtttggggataaatttgggcgaattggtttatgggtgatggactctgctgtctattttgatctgattgatgatgcaattacaaataaagtatttgaatcggaagaccagattatttatggcggtttaccggcaacaatgggcaagcctgtgttagtaacggataaagccaaagctaacaccattttaggcttacaagccggagcaattactatcacgaattcgcaattaccgggtttccgagcttatgacattaacagtgaagaaaacttagcgattggtattcgtgcggaaggcacatttaaccttgatgttttaggttattcgtacaaagaaagtgcgggagcgaaccctaacctttcgaccattggcacggaagcaagttggcaaaaatatgcgaccagcaataaaaatacggctggcgtgttaattgaattaagctaactaagttaagtgaatataaaagcggtgcgtttttgcaaaaaattaacaaaatcgtaccgctttttatgttgagaaggagtaattaatgcaattaatttatacaacgcaaaccacaggatttgaaccgcataaacattaccgaaatccgctgtattttgaaaaagcagaaagtaaggtgaccgatgtggtgatttatggggattttcctaagattgcacaagcgtatcaatccttaggggttaaggttcaatgggttgatgaacaatctgataaaaaaccattagacaagatgaccgtgccagaattaaccaccgcacttaaagccttgaatgtggaaattccacaaggagcgaaaaaagatgagctgattgcattattaaagcaagcgaaagggggcgacaatgaccctgaacgtaccaacggatagttatgtttctcttgaagaggcgaatggctaccatcaattgagggccagttttgatacgtggaatgaacttgatgatgaacagaaagctcggcgcttagtcagtgcatcagattttctcgatcacaattatcgttttgtgggagagaaagtagacccaacacaaatcagacaattcccacgtcaagagaatagccaagagagtagcgaaatcccgttacaagtaaaatatgcggtttgcgaattagcattgcagtctgatctaaatcaaaacccagaacagaagatggcaagcgtgaaagtagggcctgtttctgtcaattacgaaaatcaagcgactatcagtggtagtagcaatcggtttgagtatgtcaaaaccttgctttctcgctttttaaattcatcatctactaacaatgtgtccttgttaagggggtaacttgtacggcaaattaaagcaaatctccaagcagttaattcagaagtttggttcgccttgtgtgattaaaacacaaatatctgggcaatacgatccagccacgggaaaaatgcaaactgagatcaggaaacagaatgcttactgtctttttgataatctggcttatgatttttcagtaaaccgagaatttgcaacggtacagcaaggcgacgtggtgatttatctgacagaaaaagcagaagtcggctcagcggttgaagtgaatggcgaggtgtggagcattattgccgttcagccgataaaacctgctagtgtagcaatgctttatcaatgccaagggagaaaacaatgagtagttttattgcacaaattcagcaacaaattgagcagattgagcaacggaaaaacttagtcattcgtaaagtagcgttagatgcttttgcgaaagtgcaagcgaaatcgcctgttgatacaggggcgttaagacgaagttggactgtgtctgtctcagctttacccacgaattttaatggctcaaatgaacatattggcaaggcgaaatttggcgatgtgatttatattgcaactaacttgccttatgcccctgcgttggaatatgggctttatcctaatcctccgaaaaacccatcagggaaaacgaagaatggttattctatccaagctcctcaaggtatggttcggataaccgttaaagagttaaaagcatatctagcaaaaaacccaacattagggctttggtaatgaaaaaaatcattcgatccattctacaaacgcaactaacggaattaggtaagttcaataccgcttgggaaggggtaaacaataaagtgagtttaccttatcaagcggtttttctttctgtaacaaccagtgatacagcaagtatttccgataaaccgctttctgttgaaacagggtttttacaggtgaccttgttctatccaaacggcaatggcacgcacgctatcgaagaaagagcggagctcatccgcaatcatttttacggtcaatctatcattgaagagaatgttcaagttgttatctctcaaccgcccactattggcggtatttttttaaatgatgataagttggctttacctatcacaatccattacacagcctacgagctgaataaggagtaactatggctcaagaagtcaaaagaacactggttgtcagcaaggaaaccgtttttggcacaaaagctgagaaaacgggagccaaaatcattccacgcattgaaacatccttaaatgccaattttgaatcgttccaatcagaagaaattcgttctgatttacaacgttccgcctctattgtcggttttgaaaaggtcgaaggcgatattaaaggtgaactctctgcggggcagtggtcgcagttctttgctgcggttctgcgtggtgcatttaccacagaggctaaagccccgattattaagaaaacctcaaatggtgctggcgagaaaaatggaaaaatccttattgtgcctgacgctaagcacaccacggattcattcaccattgaagagattttccaagatattaacgtaaaccgtgtttataccggttgtcgtgtttctaagatgagtattgatgttcagcctaacggcatttcctctgtcaccgtttcattcttagggcaaaaaagtgaagagctacaagccacttactttaccaatcctaccccgattgctcaatcaggaaaattggcaggggtaaaaggaaaactgttactcaacaaggaggaagtcggttttgtgacaggttttaagattgacatcgatctcggtgcaagcagtgagcctgttttaggtgcaacttacgcccctgatgtgtttattggcacagtcaaagtcagtggttcgttttctacttacttgaaagataaaaagatgtggcaagcggttagaaatggcacatccctttcacttgccttacgaatggatgctgaaagtgaaaccaactcagattatgttacgttaattttacctggcgtgaaactcacttcatccgaagtcaacagtggcgataacttaattcaaaccctgaattatgatgcgtttcccgctgtttttgatgcacaaagcaccattgatgatagcttgaaaaaagcaaccacaatgattgtacaagacacactcgcctaaccttaaccaagctccttaaacggagctttttttatacctaaattttacctaaaccgcctttattggcggttttttcgtttataaggaacaaaaaatgaacttaaaaaaccttgccaaagagaatatttcagactcacatcgctttgaacttgttcatcctgtaacgggtgaaggattgggagcatttattagtgtagtgagcgcaaaatcagatcaagctcaaaagttctttgcaaaacaattacgcaaagagcaaaaacgcgaattggaaaatgctcgttctcgccaccctaaatttaaggaatttgatgaaatcaaacaagaaagtatcgagttagcattaaatcgtatggttggttgggaaaatgtggaatttggcgacaaaaaagaactgccattcacggaagaaaacgcccgaatgttattaacggaatgtgattggattattgaacaagtccttgaacattctaacgatttgggaaagttcttgaagagctaattgatgatttgttggcatacgctaaaaaagaatttgaattagacaaaaagccaaaagattctaattgcaccttacgagaacatcttttggctattcaagagcagacgggcagtgttcctgaagagcttgagaatatcgaaattagcccagcgataagttatctgctgggctttttttatgaattatctctttctcgacagtcaggtatggggctttgtcccattacttatgctgagattgaggcgtggaatagactgcttcagatagagttagcagtatgggaaatcaaggtaattaaacagcttgatgtgattttcctgaatgtacaaaatacggagatttagtgtggaaacctttaattttgctcccgattggggaatgcaacttgctaagaaacctgatgtaatcaggcttaaatttggtaatggatacgagcaagtatcgcccaaaggattaaatcacaatctccgtgtttatgatgtttcttttagtggcacagaagagcgtattaagcaaatagacgcatttttagatagacacggtgggtataaatcgtttttatggactccgaacagttcaacacaaggaaaatttcgttgtgacgaatggaaaacaaaccaacaacaaggcttttggacgctttcagctcaatttagggaagtggtagcgtaaatttgttgaaatttaatcggtgtagtgttagatttcaaaaaaaggagtcgcatatgttcttattttcctgtgtaaaagccgttttcatcggttggctgatgagttgggttatatttttcgtattaggggcttttgctcaagatattacgctcttttatgccacgatttttggtctatccgtcaccctgattggctctgttgcatttgggctttataaaaataaagtctatttagatcgattaaagaaagagctggaaattcaacagcaaaaagacgctgagaaaaatcaggtaaagcatgtaatcattaaatagattttgcaaaaaatatcaatatcaaaccgcttgtgtcatgagatgcaagcggttttatttttgaggtaggaaaaatgacagatttagcaacattagccattaaagtcaccacaagcggtgcgggtaagtctgctcgtgatttaaacaatgttgaacgcgccgcaaaaagaacagaaaccgccactgaacaattaaataaatgctttgggcgtttacaggcgttattggctttatctggaataggcggtgggatttctcacctcttagcgctggcggacaaaatgcagtctttacgcaatcaagtgcagtttgtgacaagttctatgactgaaatgaaccaagtgcaaaaggaattatttgagattgcccaacgtacaaggggaagtttagaggcaacaacaacgctttatacccgctcagctcgtgcgttaaaagattatggttatgcgcaaaaagatattctgcaatttactgaaacaatgaataaagcaatggctgttggtggtgtgagtgctgaggctcaagcaagtgcattatttcagttgtcgcaagccttaggttcagggcaattacaaggcgatgaatttaaaaccattgcggaatctgctccgattattcttgatgtgcttgcagaatatatggggaaaagccgtgcggaagtgaaaaaattagcaggggaaggacaattaacatctaaattaatttttgaagcgtttaacggttcaacggaaaaaattaaccaaaaatttgagcaaatgccgttgtcctttggtggcgcaatgcaacaaatggaaaatgcctttatgaaatttgcggatgaacaaaaccgcactttaggtattacagaaaacttagcggcaggtatttcttttcttgcacagaattttgagtatttagccggtgtgcttttggcaattgcagctggcaatggggctaagtttatttcaacgttggttcttgctcgagtggaaacacacagacaagcgcaagcgagtttaatcgctgcgaaagccacacaaacccaagcagcggcagaattagcggctgcacaagccaaaatgaatttgttgaattcagaaatgcaattagtacgaaccaagaaagctagagcagcgattgaggctaaaatggctcaacaagcgcaagttattacggggcttattaatgcggaggcagctgctatgaataatcttgctgcagcctctcaacgcgcatcaattgcaagcagtgcagccgcaggagccaaaaatttattaagtggcgcattaggtcttattggtggccctatgggagcggcaacaattgcggcaggtgcattattttatttcagccaaaaagcgcaagaagcaaaagaggcagcgttagataccgagagtgcgaataaccgtttaaaagaaagttatgacggcttaagcgaaagcgcgttaaccttgaaaatttttgagcaaattcaagcaatggaaaattatggtgagcaaatttccaaagtgcaggcggaaatctctcaaattcaaacaagtgcgtggcaatttggtttggaactgtctgaaagttccaagcaagatcttgaaaaattaaacgcggaattagaaagaattcgggaaaataaaaatatcgatctttcagttttaagcaaccaattaaccgctcttggtggtgtgtttttgtcaaatggaaaaagcattgatgattttcgtaccaaaatgaaaaatctaggtatcgatgccaatacagcagatggtgttattgccagtttaagtaacacaataaaacagcagaaagaggcggctcaaggtggcgtaaaagccaatttagagctagatgaggcgtttaagaaactaaaagagcgctctttgacggtggctcaaaatcttgaagtggcaaaattgaaacagcaaggacaagcagaatccgcttttgttttagcaggcttatatgaattacttggggaaaagggggctgaatataaccaagtgctaattgatattgccaacggtacgattaccgcagctaatgcagcggataaaagcattgatttatctatcgaaaccttgaataagctgattgaaggcaagcaagtattacaagggatgttcaaagatcaagctcaaacagaaagcattaatcagagtttacgtggcagtcgaggtggcggtgaaaatgcccgtgatagctggctttccttttacgatgagatccgcaaacacagccgttcgagccttgaagaaattgatgcagagcaacaacgaatgctccaacgcttggaagaacatatgaaaaaaggggtagtttcacacgaagaatatgagtcagcaaaattggcgatttcacaacgttttgccaatgaacgtgcaaaattagcagaacagttcgcccctgagttgcaatatgcacgcgagctaaaagagcatttacaagatattcaacgacttaatgcggaagggcgtttaactcatgaccaagcgaaaaaagccacagaaaacgccacttgggatgcgggaaataaacaggcacaattagctgggcaaaatgcagtgagtgaatatgaccgctggaaagctgaattcgatccaacgcaagccatccaaaatcagcaaacctcaaagttagctgaattacaatcattgtacgatcaggaattaattcaataccaagattttgtaaatgcaaaagcacaaatcgacaacaaagctacacaagatacgcaaaatctgtttatgagtagtatctctggttttggcggagcaattgatacaatgcttggggtaatgcgtaacgcagggcaagaacaatcagatatttacaaaacaatgtttgcgatgtcaaaagcatttgcaattgcggacagtattatgaaaatacagcaaggtattgccaatgcagctgctcagccattccctgcaaatattgcagcgatggcaacagtagcatctgaaactgcaagcattatttccactattcaatctgtttcattaagcggtatggctcactctggtattgatagcataccaaaagaaggaacgtggttgcttgatcgtggtgagcgagttgttgatagtcgtactaaccaagatttaaaagcctttttagcaaatcaaggaaaccgaaatcaagcatcgggtaaatcatctgtaaatgttcaaatcatcaacaatggtaatgcggtagatgccaaagtttctcaagaagaaacgccagatggaactcacatcacagtggaattgttaaaaacaatgagaggaatcgcaagagaagaaagtcagaatgcgatcaccaataatttcgctcgtgcgggtggtcaatttagacgataggagtatgtaatgccaaaatccctaccccaaaaaatggcaaacgaattgccaaaacttgaacaaaatgccttgattgaactgtgggaaattgatttaaggcatatcagcagtaatagcgaccaaacacgaaaaggggagttgttacgctttcacaatggcttaaatcaaggtcagcagaacatttggtggcaaggtaacgagtaccaagcctatccaattaatgcggacggttttgagattagcggtcaagggccgagtaaccgaccgactttgacaatctcaaacctttacggcattgtcaccgctttagccgcagatttcggacaaggaattggggcaaaggtgacccgtcgtttagtctatgcacaattccttgacgctcgtaattttccaaatggacaaaatccacaagccgatccgacacaggaaagtgtgagtttgttcattattgaacagctaaaaatcctcaatgatgaagtggcgacatttgagctggctttacccgcagaaacagataatgcacgtattccgttgctgatgattacgtctgatacttgcatttggccatatcgttctgcggagtgtggctacacaggcggacctgttgccgatgaaaaagataacccgacaaccgatccgaaaaaagatgcttgctctcactgtttgcgtggttgcaagctgagattcggggctaacgccattttaccgtttgggggctttccaagtacaacgcagtatggggcttgattgctatcaaggtgttttacttgtaaactatatgagttcgccattgtgttgaactatattataaacagaagaggatttatggcagctattcaaccacaaactattgcggacagtctatttcgacgcattgaggatgctcgttatatgaagaagttcacccctatgtttattaatagattacttagcgacattgagaagttgaagttaatagtccccgattttgcgtggagcatggaaggaagtgtttatgctttagccaatcaagaaagtaaagcaatttttgcttgtcagaaatctattgaactcaatcatagcgcatcaaatatctataatttagggtttacttacgaaatctttaatcaatttgaattagctttagattgttatcgacaagcatttcagatagctcgaaatggcgacataaaaatacttcgaacattagaaggtcggctaatgaacttttttgcttatgacgatttaactcctatcaaaactgagctagataaatgtaagataaaacataatattgatattattactaaattaaataaagtatttggtagtggacgtttaatgttagatttcggtcttgaagtcaatcggcttattaatcaacatattgtttctagatttatcattggtactgagtttcgtgaaattgatgagcggttacatattgttaaccttgttcaatatgtagatgaagaagatcttgaaaagatagttgagtgtaacgctaatctatcagatttattcgcagaatttgcagaaaaaaatcacctagatttagattgcttgtatctttattgtgaggcgtataaataatgattaagcatacggaattaattgaacgagctgagattttgtcaaaacaatctagcgaaattgaatggagagatagcatcaaacatagttattattacttttatcatgagcttaaccaatttctctctaaacacaagattgatttaatggataagagttatggtgaacatcaatttgcgattgaaaaattaaaaagtattgaaaatcgctcagctaaaaccttagcaagatatgttcaaatattaaaagataaacgtgtaataagttgttataaacttgatgcaagtgtttcacaatttcaagcaatacaacaattaaaagaatgccaaaatgcgataattaaattaaaggaattggatacattattacaagaaaaataatctataagcccgatatgttcgggcttttttattgggagtaaaaatggaaacacctgatttagaatttaaaatcattgctcacgccaaacgctcagaaccgcacgaaagttgcggttttgtcgtttctaagggtggtaagttacgttattttccttgtgaaaatattgctgtcgatccgattaatcattttgaaatttcacctgatgattggattcgggcggaaagcgtaggtgagattgtggcggttgttcattctcaccctgattcagacacagaaaagggattgccttatctatcaaccgcagaccgtgaatgccaagtgcggttaaatctgccgttttggttggtttgcgacggaaaattgcaaaaattccgcccaatcgcaccgcttatcggtcgttcgtttgagaataacaagcaagattgccgcaatatcttacttgatgcctatatgttgtcgggattggatttgcctgacgatgttgagtacgagtttgaatggtttaaatcaggcaacttgtatgaagaaaacttgctccgctttggctttgagcggttagattttgaagcacagccccagcttggcgatattgtgttactgcaaattggtagtgatgtggctaatcacgcaggcatttaccttggtaatcaaatgatgttacaccacagcgaagggcgattgtctgcccgtgtgccttatgacggcgcttggctacaacaaacgcacagtatttggagatacccgaaatggtcagagttaaattttacggcgatcttaaacgatttgagcctaacgaaccgatagtgcttgaagtcagttcctttaaagagctgatgagcggactactcagtcagattcaaggcttaagccaacatttgcggaaaggctattacaaagtccgaatcgggaaacgctatttaagcgaagagcagataaaaaccaatcctacaatgacacttgcaggtgattgtactgtacattttacgcctgtggtggtgggggcagggaaatcgagtgtccttagtattgttgcgggtgcacttttaattggtaccgcctttatgcttggcccaatgggattcggaatggttcaagggatgactgcgatgatgatgggaagtatgggagctagtcttttattaggaggggcgatgcaaatgcttgctcgtccaccagatatgaacacgaaattaagtgacagcgaaaagcagcaaagcacatcattctcaaacattcgcaatcttacccctcaaggcagaccgattccgttgctttacggaaaaatgatgacaagtcttatcttgatttcgcagggtattgatacctttgatgatgtgacaacgtaaacaaattacagtcgcacaggaaactgtgacggcttttttattggagaaacattatgggcggtaaaaaaggcggtggtggccatacaccttacgaagcacccgataacctaaaatcagcgcagcgattaagtgcgattggcttaatttcgctcggtcctattcgtggtgcggtgacagcagatcagtatcagagtgccttctttgattacaccccgattaaaaactcgaaaggggagtggaattatcaaaataccttgattcgctatcgtttaggctatcaagaccagcaaccccttgaagatttcgatgcgtcagaaagagaagtgtcagtgggtgctgaagtgaaattagaacaccctatttctcgcacggtgattgaccctgatattgatcttttgcgaattactttaggcgtgaatgcgttatttagtcaaaacgatcaaggcgatacgcacggcacatcggtgcatctagagattttaattaacggtcagtcccgacaaactgtagtgattaacggtaaatcttcatcacgttttcaccgtagttatttaatcgacaatttaccaccacgtccattcacggtgacggtacaacgtgttacgccagacagtaaaagccaacgtttacaaaatgcgacattttggtcgagctacacggagattattagtgccaaattgagctatcccaatatggcgatagtggggattaaaaccgattcacgctataacccgagctttccaaacattaactttcttttgtatgggcgtttggtcaaagtgccgagcaattacgatcctgataccagaacctatggcagtggtttatggcgtggggattttaagctggcgtggacgaataatcctgcgtgggtattttacgatttagttaccaataagctagctggcttagggcaacgtttaggcgattatggcattgataaattccagttgtatcaaattgcccaatactgcgatcagcaagtgccagatggctatggcggtgttgagcctagaatggtggcaaatttatggctgacagagcaacgtgatgcttattccgtgatttcagatatggcgtcggttttccgtgcgattgtggtgtggaatggtacgcaattaacggctattcaggatagaaatgccgatcctgtctgtacttttactcaggcgaacgttattgacggtaaatttaaccgccaatatgtcccgcttaagtcgatttttaccgccgttgaagtggaatacgccgacgaacgcaacaactatcaaaaagcaattgagtatgtggcagatgatgcaatgattaagcgttatggctataacgtgaagaaaatcgttgcgtttgcctgtacttctcgtgggcaagctcgccgttatggtaaatgggtgcttgaaacttctcgcttagagcaatgcactatcagctttagcgtagggcgtgaagggttacaagtattaccgggtgacatcattgaaattgcagataaatcctatgctaatgtcaatcttggtgggcgtgtgttggccattaacggcagaaccgttacccttgatgccccgattgaagtcgctggcgaaaagtacctaagttatttagtcaatgataacaacggacagcggttagttcgtcgcaaaatttcgcaaattaacgcccaaaacaaatcgcttgtaacattagatagcgagccaacaggcttacaggtaatggatacttgggcgttgcataccccgttagtcagtacacaacgctatcgtgtgcttggcgtggcggaaaatgaagatggtagctacggcattaccgcattacagcacgagccacagaaagagcgaattgttgatgaaggggcggtttttgctcctctgtctgaaacacgccataaagttgagccacaattaacacacttaggcgtacaaccgacattaagcggcgatatgaaagtgtcgtgggaagtgacatcaggtaatggcacggttaaatatgacatcaaagtcttaaaagatggtaagttgtatctgtttaaacgtgatgaatccagtagtgagctgaatcttgcggatttagcaaatggtgaataccaagtcacgattatcgcacgagatgcacaagggcggatgctgagcgaaaaagtacaatcctttacgattgacaatccacctacacctaaaaatgtatcggtatcgggcggtttatcaggtattacgctgtcttgggattttgtggacgaagccacgcaaacggaaatctgggcaagttcaaccaacaacctagccaacgcagagcggattgcaaaagtaaccgcaaatatctacacccacaatgtaggtccacgccaaacacgttattactggctacgtcatactcgtggcattaacgtgggggattggtaccaacagcaaggtttaagtgcagaaacaggggcagatattgatgcggagcttgcgttactgaatgaaaagctaagtcaaaatatcattgaagaagtctttgatacagcaatgccagctcgcaaattggagatgatcaaaaccgttgctcgtattgacaacccaacggaaaacatcggtcataaacagttatacaacgaagctgacggcaaactgtatgtttgggacggcagaaaatacactgctaaagtacaagcggtcgatttagaaggaaaacttgcaagtagtcaattagaccaagctcttattaatcaacttacgacagcaagcagtacagccaataatgccttatccaaagctaacacggtacaaagtgcgttagctcaagaggtaaatcgacgcacgcaagcgattcaagcagaagccaatgctcgtggtactgcggtgagccgattagagcaagccgaccgtaagcaagcgcaattaattaccactgccacaaccaaagcagataacgccttgtcaggtttatctgaagaacgtcaagcacgtattgctggggataatgcacaagcacaggctagagcgatattaacaacgaaggtaggaagtgtagagagtggtatttctaccttgcagaatagcgttgcaagtgctaaccgtagtgtttcggagctaagtcagagccttaatgctaagattgatgggattgcgattggggggtggaatttaattaaaaattctcgtctattaaacaacactacccactggaatgtaattggtggaagagatgttagaaatggaatcgcagttttaaaaaatttaaacacggcaaactggtgctggaggcaaggtgcaatcaatgcacacaatccaagcagtatctattgcgggcaatagaaaagcacttgcgggtatctctttaggtgcaaatggaggaactgaaagttctgtgattgtgatggccgataaatttaacgttgtcaaaaatgcacgagatggcaacgttaagccaatgtttagtgttgttaataaccaagttgctgttaacggtgatttgattggagatggcacagtatcggctcgaatgatggcggctaactcaattgctgctggggctattcaggggggagcagttcgcgcaaatcatgttgcggcaggggagatttctactgaaaaactggcttcagaggcagtcactaccgagaaaattcgaagcaacacaatcacttccgataaaattggtacagggcaaattatcacaaatcacatggtggctgggtcaatagatggaaaaattcttcgtgcagggacggtaacagcagataaagtggtagctagagtctccctacaatcaccagtgattcgaggggggattttggaagttgggagccttattggtggtaacctctatgaggttaaatctttcacaccggctggtcgaaatcaaatgagcattacgatcaagccttcaatagcacaacgattactgaaaatgacttgggattatggtactgttagattttcaggtaattctgctgctattggtggtactggcgattgggtaacaagcataaaaaattcagcaggtactgtatcacagcatttaaaaggattttacacgctcgttatcccatctaatacacaggtaacgttatctttaacatttaataccacccgtataatgaatcaaattcttgtagaaacagttgtttattctgggtcaagttatatacaataggtcataccttatgacatagggggaaattatgaaaatcttgtcttcaatatcgatgattgctttaggcgtaacattgattggttgcggaagtggtggaggcggtggaggcagtagtgctagcaatccgccctctcaagttccgacaaagaccgaaccgcaattacccacaacaccgccaacatctcaggttgaaagtgaatggaaagctaagataagggaggcgaagttaattaggatcgatcatgagacacttagactttctgacgatgtggcttttccatctcagatatttaatatggcagatgagaagcttggtaagctagaacaagaattagggcgtaattgggttctcaaagcctacaacttaccttattctgcagttggctatgtattaccagcagatgtctcaacagatgaatatggacgtgtcattgatagccgagcgaataattatatggctgaagtagttggtgcgagaacggaaatattaccaaaaggctcagcgtactatgaaggagtttcttttggtgcaaattctgagggtaaattgaagctgtccataaacttctcagacaagactatttctggttcggtgactgatagaaagctacttagcacaaaagaggcactagcagatattagcttgaaagaggcaaatatttcagctgttggagaacaccatttttcaggtgttgcggaatcccaaggaatacaaggtagctactatggctcatttttcggtccaaatgctgaagaagttggcggcatcattcgagatgatgctggcaataagtatgaaggattttctggcactaaataatttcagcctcttaacgcaaaaaaccttgatagaaaaaactatcagggtttttctttttctaaaacaaaccaaaggagtcttatatgcaaaaagatgtgaaataatggtgggtattttagatggggaatctctgtaagtctttgttttaattaaataaataaacgccttttattcgatatgtattgcccttctaaggcgtgggtcaaaggttcgaatcctttagggcgtgccatttaacaaatgaatcttttaagttcacctcctgagtttgataaaataagcaaaacccagcctatttaaaggtggctgggttttgcaagtgatgtactaattgcgaattttattgagctaaacacacaccaaattgatccgccaaagattgtaaaaattctggataggcgtttttacttaattcaatttttgcccctaacggatctaattgccctactttggctgatgtgcctttgcttaagctctcaatcacttttggcgtaaattgtggctctgcgaataaacattgtgcttttttctgagcaatgcttttcttgatggcatttaaggtttttgccccaggtgcaacggttggattgattgtgaatgaacctaatgatttcaatccataagcctcttcaaaatagccgtaagcgtcgtggaaagtgtagtaaccttttgattttacaggttctaactgttttgcaatctcgctatttttcgttgccaatgtcgctttgaaatttgctaaattctctgcaatttttgctttttgctcaggtagttgctggcttaaacgctcagcaatttgttctgcgatatgttcacttgctttaggtgataaccaaatgtgccaatcttcgtcgtgactatgtccatcgtgactgtggtcgtggtgagcgtgattgtgggaatgtttatgctcgtgtttgtgatcgtgtttatgatcgtgcttgtcttctttttcttcacctgaatgctccacaagctctttaattgcaggcacatcttcaagggttaagactttctcttttggtagtttttcaatacttttctctaaaaaagtttccatctcttccccaatccatactacgagctgtgccgattgaagttgttcaacatcagagggtttgaggctgtaatcgtgtggcgaagcactggttggtaatagcactttagtttctgtgacaccgtcggtaatcgcattagcgataaaacctagtggtttgactgtggttaaaacatcggcattggttactgcagttgcccccaataatgcaaggcttaataaactttttttaaacatagaagatctcctctcaaataaagcggtgagatcttagcagaatattgcaattaatctataatttttttatggttattagcattaatcacaaaaaaataaggacacccaaaagcgtccttataaaactgacggtaaaactacaacaacatcttcacaatcttatccaatttcacccgtccaaattttttcagtaattttttcaccttttcggggtaatcttttagctcttctaaatcgctataatgggttaagactgttgtatgtgtacgaatttgtgctaactcaccttgggtcttttcactcagctcaccctttggatcagaaatcaacacggcattttctgcatctaatttccacgcacgtgggttgagattgtttcctgtaagtagaatataacgctcatcaatccatacgccttttaagtggtagctgttcttaccatctttccacaagcggatcgttaattgcccattttggatataatgatcaaactttttcgtaaatgctcgcagatttttttcatacagatacggcaaagcggacgccatcgtaaatttttcttcaggtggcgtgaaaaagtcgtttgctgttttatcaccaacaataatttcaatctgcttgccattgtctagtaaccaagcgatacgttggctgatagaacgtgggaaattgaagtacggggtgcaaatggttaatttctgctgtacttggaaaaatagtgcttcaatcgttttattcagcggatttttacgccctaagcccactaaaggtgaaagcattagttgggaatgatccatcgttctaccgttaaaacgatattcctgttggcttaattctttacgaaacgttttaacaagcggtcggatttcaatggtttttggacgatttgcttgatccaagcgatttaccgcagggttgctcaaaatattctgctgaatgaaattgacccagctgtctgccaaagttttattttcaatttgatgataacggtcgtaacgataacgctcaaactgctgtaaatagacgttgttgatgctcgctccgctataaagcagggtatcatcaaacacaaaaccttttaggtgtaacacaccgaagatctcacgtttattgacaggaacgccataaaacgcaatctcttgctccgtcggcaaggcatattgctcacgcatctgggtgtaccagtcggcgtttgaactttgggttgcttcgccaatacgtccacgttgagccctatgccaatctacaaggattttgatttccaactgtgggttagctaatttcgcttgataaagtgcatctaagatctcttgcccagcttcatctttttcaaaatagagagcggtgagataaatgcgacattttgcttgttttattaacgctaaaatgtgttgtttaaactcagtgctactggtaagaaaatccactttttctaccgcttgggggataaaagtgagattatctaagtggcgttttgcacgggtttgtttgtttagaataagcatcttatgctccatttttctttacttcgtagatagtttctacgcagtaacactatccctacttttcttttctttgcttcgccaaagaaaagtaggcaaaagaaaggcgaccccaagcgtttcttcttcctacgcttgttgctaatttttgggacgaacttttcaaactcgcttgcttcgcaagctcaaacacgaaaagttgtcctcaaaaattgacgcaaccgcttcggcgaaacgcaggggaattgatcgaacatctcgatctcaactttgcaaaaaattaactaaaacttaccgcttgtttggcggtttgggttcccttctgaaccgcctgagcgtgtttaaatttgtaggaacatttttctctgagccaacgaagttggcgaatttaaaatgttccgttaagcaaatttaaactaagcgaagataagcggtgaagtagggttgcctttcttttggttacttttctttggcaaagcaaagaaaagtaacaaaattaagcgatgatgaaactacgcaaagtttcttgtttcaccttccccaaccacattctccacacaacgcccacaaatttcagcgtgttctgcattcgcaccaatatctgtcgcatagtgccagcaacgtgggcatttttcaccgtctgcacgttctactttcaccgcaagacccgctaattcgccttctgtaacatctgcttctgcaagtggtttaacaattgcttgtgaagtgattaacacgaaacgtagctcgttgcctaactgttctaacaacggacgaatatcatcatttgcataaacggtcactttcgcttcgagaccagcaccaattaacttgtcgttacgcgcttgttctaagacacggtttacttccgcacgcacttttaacagtttttgccagtagttgtcatctaatttgttgctttcacttaaaccgaataagcctgtgtagaattcttcagtaaagacaaattcagaacgcccttccacctgtggtaagtagctccaaatttcatcggcggtgaaggataaaatcggcgccacccaacgtactaatgcttcagagatatgccacaacgcagtttgacagctacggcgtgcaaggctgtctgctttggtggtgtattgacggtctttgataatatctaaatagaacgatcccatttcgattgaacagaaacgcattaaacgctgaacaacggtgtggaattgataattatcataggcttctttaatgtcgttttgcgcatctaacgcacagcttaccgcccaacgatctaatgcgatcatttcttccggtttaaccaaatcacgttttggatcgaagccgtttaagttcgctaataagaaacgtgcggtattacggatacggcgataagtgtcgcctgcgctgtttaagatgttgtgcgaaacggcaatttcacctgtgtagtccgtagaagcaacccataaacgtaaaatatctgcaccatttttgttccacacctcacttggcaaaatcacgttaccgagtgattttgacattttgcgacctttttcatcaacagtgaaaccgtgtgtaagtacttgattataaggagctttattatcagttgcggtagaaagcatcaatgatgacataaaccaaccacggtgttggtctgaaccttcaaggtacatatccgcagaattgccattaaactctggacgttgttgtaccacagacgcataggttgatcccgagtcgaaccacacatcaagggtatcaggcactttacgatagattttcgcatcttcttcgcctaaaacttctttcggatctaaatcccaccacgcttgaatgcctgcttgttcaacacgttttgccacttcttccaaaatttctaaggtgcgagggtgtaactgttctgtttcgttatgcacaaacattgtcatcggcacaccccaagtacgctgacgagagatacaccagtcaggacggttcgccaccattgtatcaatacgagcttcaccccaacttgggatccaacgtacacgtttaatttcgcctaatgcctgtttgcgtaaaccttgcgtttccataccgataaaccattgcggggtcgcacggaaaataatcggagttttgtgacgccaacagtgcggatagctgtgtttgatacgctctaatttgagcaacgtccctgtttcttttagtttttcaaggactaaatcattactttcaaacacgcctttgcctgcaaagaatggcgtagttgaaataaatttgccatcgtttgccaccaagccagccatttctaatttatatttttgacccacaatatagtcgtctaaaccgtgatctggtgcggtgtgaactaaaccagtaccgccatctgtggtaacgtgatcgcctaaaataaacggcacgctaaaatcgtagaatgggtgattgaaacgcattaactctaagtcacagcctttcgctgaacctaacacttcaacttgctcaacgcccgttgctttttgtacggcttccactaattctgtcgcaagaataacacgctcatcgccaaactgtacgagctgatattctaattccgaatttaacgcaatcgcacggtttgacggcaatgtccaaggggttgtagtccaaatcacagcagaaatctgaccgcttcctttgccctgagcattaaatttcgcttccacagcaacaggatctaccgctgaaaaacgtacatagattgatggtgatactttatcttcatattccacttcagcttcagcaagggaagatccacagtctaaacaccagtgaactggttttgaacctttgtataagtgaccatttgcaatcactttacctaatgtacggataatatgtgcttccgtatcaaaattcattgtgagataaggattatcccaatcgcctaaaatacctaaacgcataaaatctgctttttgaccatccacttgctcttttgcatattcacggcatttttgacggaattcagcggttgaaatattttcgttcggtttacccaccaaaccttctacttttaactcaatcggcaaaccgtggcagtcccaacctggtacataaggtgtatcaaagcccattgcagttttagatttgttaataatatctttaagaatatggtttacagcgtgtcctaagtgaatattcccattcgcatacggagggccatcgtgcagaataaaggatcttttcccttttgatgcttcacgaattttttgatagagctttttgtcgtgccaattttgtaacatcgcaggttcacgcttagcgagatccccacgcatcggaaagcctgtttcaggcagatttaatgtgtttttgtaatcagtcattttgttgttccaattaataaaattaaaagtctttatgaaaaataagtaagcggtagaaattacccactattttgcaaaatagatcgtactatttggtttacctcttgatgatcttttatttgataaaggtaaatatttttatcctgttttaactgttcaaggcattgttgataatttactgccattcgttcaatcacttctcgctcaacaattcgagggagagtgccttctatattacgcttatcctcaaaccgttgtctattacgcataatactcaattctgtgtttgaaggtaatgcaagaatataaatttgataatcctgattttttaattctgataataattctattgctgtatcaatattattaaaggttgtttcatatattatattcaacctattttcagtcgcttttttcaataacccctttgctactcgatgagcaaaattgcccgtttttttatgagcattatctctaccatatttttcaatgtattgacttattttagggtgaatacgtctataatcatcagcttgaatagggaaataatttaactcaaaattatcatataacaacttaatacaagttgattttccactaccactcacacctgcgacaatgatggcttttggtaaatctattgaggttaaaccttgaacaaaaactctatcatcaaagagtgcttgaatttgttcttctgttggtttgacctctctcaccataatcaatgttccaaacgcaatttttgatatttatcttgcaaaatcagcacctgttcaacaacagggatcacgtccatataatgttcaggaattaaactaaaatactctaattctaaatggtgtaattgaatacgatcactttttcctatttcagtctgtaatgcccctgtcattagcatatcagcaaaagtatccgcacaaatttcgtggaaaacatcactaaacggcacataatcttgctgtaaactggctaaaatttgggcttttctttcttctgttaatctcattttatacctcttgaaagaataatctcaccgcttgtacatctttctcaatttgcaattttaactcatcaaaactcgcaaacttaatttctgaacgaaccttctttaaaaaacggacttcaatcgcttgcccataaatagaattatcaaaatcaaacaaatgtacttccaataacggctttgtcccatttatcgttgggcgattacccacattcgcaatactattaaaaatccctgctgatgtttttactttgactgcataaacaccctgaatagccgttactaaacgatttagcatcagatttgccgtcggaaaaccaatggttcgacctaacttattaccgtgagcaacacgaccacaaattgcatagggttttcccaacattttttctgctaactgcaaattatcattatgtaacgcatcacgaataagtgaactactaatccgctgttgctctaaacaatggctgtgcgaattttctacgtcaaacccaaattgctttcctgcctgttgcaaactatcaaaagtccccgaccgcttgtagccaaactggaaatcgtcaccgacacttaaatacttcacattcaacttatcgactaataaatgttgaataaattgctctggttgtaattgagcgaactgagcattaaaacgcacacaaagcaaataatcaaaaccgatttcttgtaaggcgtgaattttatcgcgtaaacgcatcaatcgtgcaggagcggtcagtttatcttgttttttggcaaaaaactcacgaggctgaggctcaaaaatcatcaccactgacggcaaacgcaaggcatttgctttctctagcaaacgcttcaaaatttgctgatgccctaaatgaacaccatcaaaattgccaatggttagcacacagcccttagaaaaatcagcacagtgagctaaattatgcacgcctcgaattaattgcatcggataaaaatagattacgttttcaaacaaaaattatgcccgattatacgaggaatggggggaaatgaaaagaaaagcataaagatattttggcgatctttctagcttatcttggtataattactgtacgcaaacgtttgcttaatgttatacttatgaataagtttttttatttaagaggattgctatgacagttacacaacttagttataaagacgctggtgtcgatattcacgcaggtaatgaattagttgaacgtattaaaggcgatgtaaaacgtactcgtcgtcctgaagtaattggtgggttagggggctttggggctttatgtgccttgcctaccaaatataaagagccgattttagtgtctggcactgatggtgtgggtacaaaactacgtttagccattgatctaaataaacacgacactataggtatcgacttagtcgcaatgtgtgtgaatgatttagttgtgcaaggtgctgaaccgctgttcttccttgattactatgcgacaggtaaattagatgttgatgtagcaagctctgtcattaaaggcattgccaatgggtgtgaaaaatccggttgtgcattagttggtggtgaaactgcagaaatgccagggatgtatcacgaaggcgattacgacttagcaggcttctgcgtaggtgttgttgaaaaatcagaaattattgatggctcaaaagttcaagttggcgatacgctgattgcattaggttcaagtggtccacattcaaatggttactccttgatccgtaaagtgctagaagtgagcggtgcgaaaccaacggatttactcgaaggtaaaccattgagtgagcatttccttgcaccaactaaaatctatgtaaaatcggtgttagagttaatcaaacaagcagaggttcacgctatcgcacacttaacaggtggtggtttctgggaaaatatccctcgtgtattaccagccgatgtaaaagctgtgattaatgaagcaagctgggaatggttgccatcatttaaatggttacaggaaaaaggcaacatcagccgttatgaaatgtatcgcacctttaactgcggtgtaggtatggtgattgctctacctgaaaaagatgtcgaaacggcattaacagtcttaacagaagctggcgaaaatgcttgggtgatcggtaagattgaagcattaggtagtggtacagagcaggttgaaatcttgtaatttctcccaccttattcgccccccatccgcccttcgggcaccttcccccgcaagcgggggaagaattggaggggagggggaagtgttgtagagcggtgttatgagaaaatttttcccccatttatgggggaagtccctgagcgttagcgaaggggatgggggttgagggtataattgaatttaggtaaaaaaagtgcggttgaggtttgatctgcaccttaattagttggttgtttagtccaactttgggggtgcagatcagtttcaaccgcacttttttattcggtgaagattgacatgaggttgtcatgtcaatctttttttggaggattagatgactaagatgccattttcaatccaaacttgaactttttggtctccgttaatagtgtaaacgtcataggtacgtccattttttgtgactgcactagaagacttattccagcttgccccagatagtccaccagatgcgtctcccaatttgcttgaactaacattagtatccgtcaaccaatcattattgttgttacctaagtcaactttgactttgtcgccgttattcacattcaatcccttgtagattgtcaccggcccttctaagcctgagtttttcaaatctccatatctaatgccgataactgcgccattatccattaactctatgcgctcgaagcctttcactttgtctgtggttgctcttgcgcctcccactatgcggtataagtcaatgcctgtgcccccgtcaatcaacgagcctgcgcctatgccttttgagtcttggcggaaggtgtcgttgcctgagcctaggttgattcttgagccttcaccaatttcggtattccatgcgatggttccgtttcctgcaaaggttcgaccttgctcgtttttactgtagtttttgatttctacaatgtcgtctcctgagcccatgtctaaggttgagctttggaagcggtttgcgatgaaggtgtcatcgccattacccatgttgacacatgatgacgtctgtgccttgttgacgtaagctcttatatcttgttcctaggtcgttatccaccactaaggtgtcgttgccttgttggaagttgaagtcgagcttgtagtttttacctgattggtcgttgatgatacctagactttcatgcacgtagacagtatcattgctgttaccccaagtatattttgcacctgcgccatcttttgatacagaagttggcttgctgttgccgtattttccttcttgtacctgttggagaccccatgttgggtcgttaccccagtcttggtagacgtctgaccatctgtcttcccaccaccataatactttcactcggctataacccacacgtcctgtcggtgttccattaccatttcctacgacatttgtgtattccactttgtctgtcgtggtggtgacgtccgcactttgggtgattctgtcttcgttgttatacgattctatcttcacttggcttctgtctttcactgcgtctggtgatagggtgactttgccgtcagtttgcgacaattgaacaccgtttggagcttgagtattgttgctaccatccacctgtttcagtttccagcttccgttctctttttcatatacaagcgttttggttttgttttgctcatccgtgcaagtcaacttgaacttgttggtgttctccttcggtgtcactattgcaccgcctcggttagtaccgtcaatctctgctgttgatttcgctggttgtggttcctgagccgcttgagctgttgcatttttacgtgcaataccttggctatcaagtgctgttattgtgacgttggttttgtcttttactgcacttggggcaaaggttacttcgccagtttgggcattcagtttaattgggccattaccgccgttagtatctacactaataccattcatttgcggatttttagttggatccaatttccattgactattctcatacttgaaccaaatcgttctgtttgtaccatcaggttgttgatagtccacttggaaggctttggtttttggctctccattagaaccttctctcggtttaacgataacgccaccttgagcagagttgtcaactgttgcttttagttcgtctagctcttctactttcggtgcaggtgtcggcgctggggtcgttgtggttgaaccaccactgcttgtgccgctgcttccgctagttgagctagtaccacttccgcctgttgcattggctgctgctggaccagttggaaccgatgctgcattgaatgtgagatctgtaagagtaatacctgaaccagcccaaggtgttccttcttcaccagtatacatctcatccattcgacctttggtagaatctggaatagttgtatatacaatatatgttactttattgttaggtgactgtgccgtcgtcttgaaggatatagtcgcttgcgtcagctttttgtgcaccgttagatagcgttgcagtgtcatcgacaaccgatttaccttggtctaggtctttcttgattgcgatttcttttggttgacctttatcatctacgtacttcacaaccattctgtcgttatcaccacccggtttcgctacgatgtcgccggagtttggttggtcgttttgaacgccgttaactgcctctgttctgcccgcagtgattgtcggtacgtctgtgcgaactttgctgtattcaggctcattggctgttgcgtctgtaggtcctttgttcagttctttagtttctgcagcgttttgtttgtactgtggcaacaaatttatccccaacggctaatggagttgctgtagattcgctaatatcaaacttgaacttaccgcttgttaccgttgtttctgcaattggttgtccgttagtttgaccttctttgtagaggtaaactttggttccatctgcttctgtgcttgttccttcaatgatgactcgctcaggatctttgtctgccgttgctgatgtatcaatcgccttgattgaggtaatcactggcttatctgatttcacatcaaacggagcatctttcttgctggtttcactttctgcagatgtgcgtcctgctacatcggtcgtggttgcactgacagatgttttatctgctactttgtcttcaggaatcgttacactgactttgccactttgatcagtggttggggtgagtttaagtgaatctttttcatcttgaacccagtttccgccagtataggtgtaagtcaatgtcgtcggtgtacccgctgttccattttcaagctctggggtgtagttgatggtgactttatccccttcaacaattgggttttcccctgttgtcgctgggaattcgatcttcacataaccctcattatatgaaggtggtgcagaatgcattgttttataagggatatttgatgggaaaagaactcatttagttgaaaaagtgaagaaaagggataaaagggagaaaagctaggtggtgtgattgaattgagtgcatttttatcaagagaagggcatttttagccaatgctatcatatgccctataaatacctacgaattaaaattgctcgccatatttaggcttttcaatatttgtaaaggttttattctgattctctttaatcatttcagaaattttttgcgcagaatctttaatacccatcgcttcaaaagatgtttttagtaagggtaatgcttgatatgttgcctgagtatcgggatataaacgtagcatttcatctactcgattaacaaccgcaacataagcctttctttccatatagaattcggcgatttttagttcatgttcagcgaggcggtttttcaaataaatcatccagttttgagcatctgaggtgtattggctatttggatattgaaaggtaattgtttggaaattaccgtacgcatttcgaatgttctctattgctctagaggccctgttaattccgaagaaatcttgtatccagttatcgcctaaacgtgcgtagtttaatcctgcaaggtagtaaacataatccatacttgagctgtttggatgagttctcgcaaaacgttctgcaacctctaatgctttgtaatattcacctaatttatagttcgcataaatcaaacttaattgaacttgctcatcataagccccttgatttgagcgtagatcaactgcatctaaatagcgaattgcattgttataatcaccatcttgtaaatatgcttgtcctttgtcataaagttcttgagaaggaataccctcaaattcatcttttttagaacctgaacaaccaacaacaagaagccctgcaaggactaaagaagcaagagaataaaatttacgcataatgatttacctataaaaagtgtctgcaaactgaaagttaatgtacaatgctattcgacctagcattgttcgtaaagttcgtacgaaaatgctcatattctacaataagaaaacataatttggaattttatcattaatgactcaacaaataacattacaaactgaagtaacttcagatttattaggtgcaagattagatcaagcgctcgctcaacttttccccgattattctcgttcacgcattaaagtttggatcgaaagtgatctcgtttcggtcaatggcaagattgtgaataaagctcgtgagaaagtattcggcggtgaattaattgaaattcaagcggaaattgaagaagaaatccgttttgaaccgcaagatattccattaaatatcgtttatgaagatgatgatattttagtgattaacaaacctaaagatttagtggttcaccctggggctggcaatccagatggcacggtgttaaatgctttattacaccattatcctcaaattgcagaagtgcctcgagctgggattgtacatcgtttggataaagataccacaggtttgatggtagtagctaaaactgttcctgctcaaactcacctcgtcactgctttgcaaagacgtgaaattactcgtgaatatgaagccgtagcaagcggtattatgacacaaggaggcaaagttgatgaaccaatggctcgccacccaactaagcgtaccgcaatggctgttcacccaatgggaaaacctgcagtaacacattatcgtattatggaacgtttccgtaattacagccgtttacgcttacgcttagaaactgggcgtactcaccaaattcgtgttcatatggcacatattgcccacccattgttaggcgatcaattatatggcggtcgtcctcgtccacccaaaggggcaagcggtgagtttttagaggttttacgcaattttaaacgtcaagcattacacgcaacaatgcttcgcttgcatcaccctatcactggtgaaccgatggaatggcacgctccattacctgatgattttgttgaattaattgaggcattaaaagcggattatttattgcataaagatgaattagattattaaatgagaaaaaaatccccaaacatatgtctggggataaaacgaaaaaagtataaaatacttaaaatttaaccaaggaaatatctatgaaaacagtaaggaatctctctatttatattgaatggcggtgagagggggattcgaacccccgatacagtttcccatatacacgctttccaggcgtgctccttcaaccactcggacatctcaccgaatcaataaaaaatgtgcatttaaatgcacatttgaaagatatgcgaactatactgatttttcatagtctaatcaagcattttcttcacaaactaaaataaattgtgaattaatgcccgtgtcccagacaatttgttgatgccggaacttcttcgcctcgagctttccattctgttggggtgtaaagatgtaatgctaatgcgtgaacgccgttggctaattcttcagcaaggcaagtataaatagcttggtggcgagcaacaggacgtttgttttcaaagagttcactaaccattgtcactttaaaatgtgactctgagcctcgtccagagctatggcgatggctctcgttttcaatataaagcgtcactgggttaaattgtgcttttagtttttcgacaatagtatgttcaacagacattttttatccttttggtttggaaatttaggtggaataatactatactttgcattacttttaattgagattatcaaggatcctatatgaaattcaataaaaaaacgtttttagttgcaaccacccttgcaaccgcattattagccggttgtcaatctcagtcaaatacactgacgtttactacgccagcaccgaccgcaatgtttaatacccataatcaaacagcgttagtgaatgtgagtacacaagatctgcgtacatcggctgaagtagcaagctataccagtgctggcaatgttaatcgtttaagtgttgtgccaacggtgacacagttataccaacaagcaatgcaacaaaatctgaacagcaaaggttttactgtagtttctggtgctggaaatgcgaatgtgattgtgaatattcgtcaattttttgctaatgtggaacaaggaaatgttcgctataaagtaaccgctaatgttggtgtagaggttgttgttcaaggtgcgagaggtcattttgcgaaaaactttaatacctcccgttcttatgaaggggcatttggtgcaaataataatgaaattcataaggtgttaggtcaagcgtatagtgagtctattcaggcaatctataacgataatgaaattagtaacgctattcatcaatttaagtaacaatgtagaagcggtaagattgagataatcttttgagattatccgtattgtgtagcacttacacaaaaaatagtagggacgccacgcttggcgtccattctctaaatttgcaaacagcttatattcaacggacgctaggcgtagcgtccctactgtatgaaaaagtttgcgtatttgctacctgatactgcctgcttacctttaggaacgaacctacccacatttcaatagcaataatgagaataccaagaatttaccacccagaagcccttgctggcaaaagccactgtattttgagtgaagatgcctttaaccacgttggacgtgttttgcgtatgggcgagggggctgaacttgttttatttgatggctctaaccatatttttaatgcgatcattgataacgtatccaaaaagcagatcagcgtaaaaatccaaaatagccaactggacgatagagagtcgccgttacctatccatttagggcaagtgatttcccgtggagatcgaatggagtttaccattcaaaaatcggttgaattgggggtaactaccattacaccattatggtcagaacgctgtggtgtaaaattagatggcgagcgtcaagataaaaaaatccaacaatggcaaaaaaattgcaatatcggcttgtgagcaatgtggacggaacattattcctgaaattcgcccgataatgaagctgaccgattggtgcaaagaacaagatggaatgctcaaactaaatcttcaccctcgtgctaaatacagtttaaaatcgttactgaatgtaccccaagagggcgtacgtttgttgattggttcggaaggtgggctttcccctgaagagattgcgatgacagaagcggagaattttacggaagttttacttggaaaacgtattttacgcacagaaacggcttcacttgccacgatcacggtattacaaatgctttatggagatctcagctaaatgatgaatttacaaggacaatttttaattgccacgcctgatatgaatgatgactattttgatcgtgcggtaatctatatttgtgaacataatgaacacggggcaatgggcataatgatcaactcaccgacagatctgtccgtgatggaattgctcgccaaaatggattttttaatggcaaatgaacgcaattacaccaaagatcagctggttctcagtggtggacctgtggggcaagagcgtggctttattttgcataccgcaaccgatcagctctttttacatagctatccaaccgctgatgatttaatgcttaccacatcgggagatattttagacacctttggacgacaagatgcccccgctgattttatcgtctgcttaggctgttgcacttggaaggctgatcagcttgagcaagaaattgcatgcaattactgggtaactgcccctgcgtcccataaaattctttttgaaacaggttatttagatcgttggagcgaagcgaatgcattactgggtatcgaaggcattttagctaaagcagggagagcctaatgagccaaactgtgcttgcctttgattttggaacaaacagtattggctgtgccgttggacaaagtattacgggcacggcacagggtttgtctgcgtttaaagctcaagatggcataccgaattgggagcagattggcaaagtgattgcacaatggcaaccagatctcttagttgtcggcttaccgcttaatatggacggtacggagcaaccgctcacgcaaagagccaaaaagtttgccaagcgcctaaacggacgctttaatttgcccgttgaattacaagatgaacgcttaaccaccgtagaagcaaaatcagaaatttttaccagaggcggttttaaagccctaaaaaaaggcaaagtcgatgcgatttcagcttgtttaattttagaaagttggtttgaacagcaatcataaaatatagcagttttgaatctataaactttgatacaacttaaacgcttgcccatcagacatactcgcaaggtagtcgcaaatcacccttgggcgttgctgttcatctgcttgtatccaacgttctgccacagatttaggcagtaagcgggttggatcgcaacttagcatatcaaacagatccattaaaatttgctgacctttatattccacccgttgcgttttgacatcacaaataacatattgatagacaaagtttttaagtacttctaacaccgcttgtgcttccgttggtaatatcgtattaaaacgcagtaatggctcttcaaactctgctgtttctgtccattttacatttgtcacaaaataattgactagcgctccaataacatctttgcgttcgtagcggtgaattgagaacaattttttgctgatgtcaggtaacattttttgaatccaagctgatttacattgagagaaggcttgttccgcattttgccacgattgcggcgtgaccattccgccaacaatcgcatcttctaagtcgtgaaccccataagcaatatcatcagccaattccataatactgcaatctaaggatttataacgggttttgtggggaagctgtggatcttggcttatttcaatttgttgaaataacgctctatctgcgacagaaagcggttcaagcacccattcaaaaaagtgagcgtctgcacggaaaattcccttacttgtttttagatcgtgtaagttgatataacggctatttggaatggcttttggagtttgtggctgagttaaatcaataaaggtaggatatttgatgatacctaacaaggtgcgacgcgtcaggttcattcctgcatttttggtataaggctcaagctgagtgacaatgcgaaaggactgagcatttccttcaaaaccaccaaaatcctgcattttataattcaatgccatttcaccgccgtgtccaaaaggggggtgtccgatgtcgtgggcaaagcatagggattccgtcaaactacgagaaggtaataaagcggtgagatcttcattgaattttgcaaatgttggatcggaacagaccgcttgaaagccttgcctatcttccaccaattttgctcttaagctactgccaatttgggcaacctctagagagtgggttaagcgtgtgcgataaaaatcatcttcgccaactgcgtgaatttgtgttttggcttgtaaacaacgaaaagcttccgaatgtaaaatgcgtcctcgatctcgttggaaaggggaacggtgatcttgttcgcgttgtttgtctgcaataaaacgtgatgtccaagctgaatccattttattttcctccttagtcacagtttaggctataatagctgataattctttttgtttaaaccttattcaaatggcacttttttattctgataattccgcaaaaaaatccgcaaaaccgaccgctttacagacctttcatatccaatctttagactatcaaggattcggcgtggcgaaagtcaatggcaaaacgtggtttattgaaaatgcgttaccgaatgaaaaggtggaagccaagattattgaagataaacgccaatatggacgagcgacagcggtacgattcctacaaaaatctgcagatcgccaaacgccattttgttcaatctatagccaatgcggtggctgtcaaatgcaacatattccactggctttacagcgagaaacgaagcaacagacgctttttaaccgtttacaaaaacttcaagcagagcctatcagatttgagccaatgcttgtcgggcaaggcacaaactaccgccgtagagcaaagctgagtatggcggttcaaaaaaatacgttggtggtcggctttcgccaagcgaatacgcgagagattatccctctaaatcactgcgatattcttgagcctgaacttaatacgcttttacccaaattacagcaactttttgccagttggaaaaataaaaaacagttaggtcatattgagctggttcaggcggataatggggttgcattgctgttacgccatatcggcgaacttcattcacaagatagtgataaattacaacgctttgtggaacaagaagatcttttgttattcgtgatgacagataaagatcagattagtcagtggcgtggtgaagttccttattatcaaatcaacggcttaacgcttcacttttcgatccgtgattttattcaaatcaaccgagaaatgaacaagcaaatggtgaacaaagcgatagtgtggctcgatctgcaatcgacggatcgtgtgcttgatctcttctgcggaatggggaattttaccttgcctatcgcaccgtttgttgaagaagtggttggtatagaaggggttgagccgatggttgcacaagccaaacagaatgctcaaacaaatcagattaacaatgcgaagttctaccaaacggatctggataaaccttttgtggatcagccttgggctaaagcatattttaacaaagcactactagacccagcacgcaatggggcttactttgccttagatcatctttgcgaattacaaccagagcggatcgtgtatgtttcttgcaatccagcaactttagtcagagatgccgaaaaactgattgcaaaaggatatcgtttaagccaatccgcaatgattgatatgtttccccatacggcacatttggagtcgatttcgttgtttgaaagaagaacaaagaataggttctctaattaatgaattcctatgtagactaaagttataatgttcttacttttgtcgcagccaaagtaaactatttttcatatatggttaaaatagaggagatgttagatacaaatctagaacatttttttaacaaaaaagcgatttttaataaaaaaagtattgcatttcataaaaaaacttatatattccattttgtcgggtaaaaaaataacccctcaaacacaacaaaaaacaactatcacttggagtgaagcaatgaaaaaattaacacaactctctttattagcattggcagtggcttctgggtctgcaatggctgcaccaaaaacctttgtttattgcttggaagcatcaccttcttattttagcccagcattaggtactgatggtgcaacactagatgcaagtggccgtgccatttttaataaattaaccgattttaaagaaggtgaaaccaccgttgttccatctttagcggaaaaatgggacgtttctgcggacggtaaaacttacacattccacctgcgtaaaggggtgaaattccacactaccaaagattttaaaccaagccgtgattttaatgcggacgatgtgcttttctcatttaatcgtcaattagatgcaaatcatccatatcacaaagtttctggcggtaactacgaatatttcgttggtatggatatgcgaaatatcattgataaagtggaaaaagttgatgattacaccgttaaaattagcttaaaagtgcctaattcaccatttttagcaaaccttgcgatggactttgcttctatctactcggcagagtatgctgataagatgttagcagcaaaaacaccagaaaaattagatagcaatccagttggtacaggtccgttccaatttgtggattaccaaaaagactcaaccgttcgttacaaagcctttgatgattactgggcaggtaaagcgaaaattgatcgcttagtgttctctattacgccagatgcatctgtacgtttagcgaaattacaaaaaggcgaatgtcacgcaatgccttatccaaaccctgcagatattgcaaaattaaaatcagatccaaacattgaagtattagaaaaaccagggttaaacgtgggctatttagcgttaaatatgactaaagcgccgttggataaccaaaaagtacgccaagcattgaaccacgcaattaacaaagaagcgattattgaatcggtgtatcaaggttttgcaaaagtagccaaaaacccaataccaccaacaatgtggagctataatgacgacgtgaaagattatgactataatcctgaaaaagcgaaagcattgttaaaagaagcaggctttgaaaatggctttgaaacagaattatgggcaatgccagtttctcgtccatataacccgaatgcacgtcgtatggcggaaattatccaagatgattggaaaaaagttggcgtaaatgcgaaaatcgtcagctacgaatggggtgagtacttaaaacgtttacgcaacggcgaagcctctacttcaatgatcggttggacgggcgataatggtgaccctgacaacttcttaaatacgctattaggctgttctgcattagaagctggctctaactatgcgaaattctgttataaaccgttcaatgacttagtcacccaagcggctcaagaaacagatcaagcaaaacgtactgagctttataaacaagctcaggtgattttcaaagagcaagcaccgtgggttactatcgctcactcaacaacgtacttcccagtacgcaaagaagtgaaaggttatgtggttagcccgttcggtttacataacttctaccaagtagatttagcgaaataaggcaacattgtagggtgggtcttgacccaccttttagtttagttatgatgggtcaagaccctccctacaaattgaaaaacgctgagatatttaatgtttcaatttattcttaaacgtcttttaatggttattccaacctttattgcgataactttgattacctttgctctcgtgcatttaatccctggcgatccgattgagatccgaatgggtgaacgtggtttaacccctgaagttcacgcacagatgatggcacagcttggcttagatcttccgttacacgaacaatactttaattatatcaagggtgtgtttcagggggatttaggtaattcgtttcgtaataacgaacctgtgctgaaagaattttttacccttttcccagcaacagtagagttagcattttttgctctgttgtggtcgttggttgctggtattttatttggcgtgattgcggcggtgaagaaagaatcttggctttcccacgctatttcgtcgatctctttaacaggttattcaatgccaatcttctggtggggcttaattttaattctttatttttcaacgccattgggcttgcctgcctcagggcgtttacctgcagaatactggatcgaagcggaaacaggttttatgttgattgatacttggaattctgacgaacctggggcattcgtggcagcgattaaatcgttgattttgcctgcgattgttcttggtactattccattagccattattactcgtatgacccgttcttcgatgttggaagtgttgggtgaagattatatccgcaccgccaaagcgaaagggttaaacacaacgcgtattgtgattatccacgccttgcgtaatgcgttaattcctgtggtaacggtggttggtttaattgtgggacaactattatcaggggcagttttaaccgaaaacattttctcttggccagggatcgggaaatggattattgatgcgatcaactcacgagactaccctgtgctacaaggttcggtgttgattattgctaccttgattattttagtgaatttaaccgtagatttaatttacggcgtggttaatccacggattagacatacttaaaaaatagatttatttgttggagtaataaatgtcttctcaagtagaaacaacctcaccagccccactaacgcctttacaagaattttggctctatttccgccaaaataaaggggcggtggttggtttaacttttattgtgattgttgggcttgcctgcatttttgcagaatttgttgcccctttcgatccgattacacaaaaccgcagtgcattgttattgccacctgcgtggtttgaaggcggtaattctgcctatttactcggcacggacgacattgggcgtgatattctttcccgtattatttatggagcaagattgtctatctttatcggtctgttgatcgtagtgatgtcctgtattcttggggttattttaggtctgttagcaggttattacggcggcactattgatattgtgattatgcgttttgtcgatattatgcttgcaattccaagcctattattaactatcggcgttgttacaattcttggaccttcgctactgaatgcggcgattgcaattgctgtggtgtctattccaagctatgtgcgtttaacccgtgcttctgtgttaagtgaaaaaaatcgtgattatgtgaccgcttcccgtgtggctggggctggcgtatggcgtttgatgtttattgtaattttgccaaattgtttagcaccgctgattgttcagatgacaatggggatctctaatgcgattttagagcttgcggcacttggcttcttggggatcggtgcacaaccaccgacaccggaactcggcacaatgcttgccgaatctcgtggctttatgcaatcggcaaactggttggtgacaatccctggtttagcgattttatctctcgtgcttgcctttaacttaatgggtgacggcttgcgtgatgcacttgatccaaaattaaaacagtaaggggaacgaaatggcattattaaaagtagatgaactttcggttcactttggcgataaaaaagccccgtttagagcggtggatcgagtaagttatgaagtcaatgaaggcgaagtgttaggcattgtgggcgagtcaggttccggtaaatcggttagttctcttgcgattatggggcttattgatttccctgggcgtgtaatggcaaattcgttacgtttcaacggacataatctgcttgatttaaaaccaaaagagaagcagaaaattgtcggtgctgatgtagcgatgattttccaagatgcaatgacaagcctcaacccaagttacaccgtgggttatcaaattatggaagccttgaaagttcaccaaggcggttcaaaagcgtggcgaaaagagcgtgcgattgaattattaacgatggtcggtattcctgacccgacatctcgtttagaggtctatccgcaccaactttcaggcggtatgagccaacgtgtgatgatcgcaatggcgattgcttgcaatccgaaattattgattgctgatgagccgacaacggcgttagatgtaaccattcaagcacaaattattgatttattgcttgagttgcaacgcaaagaaaatatggcattgattttgattactcacgatttggctttagttgccgagtcggctcaccgtattatcgtgatgtatgcagggcaagtggtggaagaaggcaaatctgaacagattttcaaatcaccgcttcacccttatacccaagcgttattaaaagcgttgcctgagtttgccgaaggtaaatctcgcttgcaatcactaccgggtgtcgtaccgggtaaatatgaccatccgcaaggttgcttgctcaacccacgctgtccgtatgcaacggatttatgccgacaaaaagagccggaactacgcacagtaaatggcagacaggtgaaatgccatacgccgttgaatgaaagtggattgccacaaccaatttagtaagatagataaatatgcaaaacaatacccaaaacccaccgcttctcaatgcggcggatctcaaaaaatactaccctgtaaaaaagggaatgtttagcaagccgaaactagtaaaagcggtggacggcgtttcttttacccttgaacgtggcaaaacccttgctgtggtgggcgaatcgggctgtggtaaatcaaccttagggcgtatgctgacaatgatcgagccaccaacagaaggggaattgttctacaacggacaaaatttcttagtcagcgataaggaaacagaaaaattacgtcgtaagaaaatccagatcgttttccaaaacccttatgcgtcgcttaatccacgtaaaaaagtcggggcaattttagaagaacccctgcttattaataccgaattgtctgcacaagagcgtaaggcacaagtgttagaaatgatggcaaaagtggggctaaaacctgagttttgcgaccgctatccgcatatgttctcaggcggacaacgccaacgtattgcaatagcccgaggtttaatgctgaaacctgatattgtggtggcagatgaacctgtgtcagcccttgacgtatccgttcgtgcacaggtattaaacttgatgatggatttacaagaagagcttgggttgtcttatgtgtttatctctcacgatttatcggtggtagaacatattgctgacgaagtgatggtaatgtatttaggacgttgtgtagaacaaggcaacaccaaagagatcttcggtaacccacgccacccttacacccaagccttgctatcagccacaccacgtttggaagcggagcatcgccgagagcggattaaactcaccggcgaattaccaagtccgcttaatccaccgaaaggctgtgctttccacgcccgttgccgtttggcgacagagcgttgtaagcaagaacgtccagagctaaaaacctatgaaaacggcacgaagatagcttgttttatggtggagtaagaattttatatttgttgtatgctttattgccttactctatagtaaggcaatttaatttctaaatctaaaccttcctcgactatatctcgttttcatcaacgccagaatttgctctttttcgcttgataccgcttggctactctgtttagccaccgtaagcgaatgttgaatagagtgagcgtgagtaatggcaatcgccaaagcatccgcagcatcagcttggggtttggcggaaagttgcaaaatacgtgtaaccatatcttgcacctgcactttatctgccgaaccaatccccacaaccgtttgttttactaaacgtgcggcatattcaaagacaggcaaatcgtgattaaccgcagcaacaatcgccgttccccttgcttgccctaatttcaacgctgaatccgcattttttgccataaatacttgctcaatggcaaacatatcgggttgaaactgggtgataatttctgtcacccctgcgtaaatacgttttaatcgagttggaagatcttcaacagaagtacgaattgctccgctaccgagatattctaaatgccgccctgtttgacgaatcacgccatagcctgttacacgagagcctgggtcaatacctaaaataattgccattttatgtccaaaaataaagtggatttgttattcacaaacccactttatagtcaatcttaattagataatcaacttattttgcaacagtgcagtttttcgcaagaatttgattgtttgcggtaaacattacgggcactgttgtttcagctgttttcgcattaaagcccatatctagactccatacctttttaccagacacaaatttcacaccgtcttgataggttgtatctactttcagatttttacctaccacttttttgttaatggttacagttgcagttgatggctcgccattgttgaaagtataaaccgctaaaacaggttggtttgttttgccatttacgctacaaatgtaagcaatagtttttgagcctgttaccatatcttttgcagcagtggcaccatcagacattgccgttcctactgctgatgctccatcaacaaccgcactacccgcattacccacagcatttgctgttgaagatgcaacatcagaaactgttgaacaagctgcaagtaccgcagctgctgcaaatgttggaagtaatttaactaatttcattgtttttccttttgtgttgattaaaaagatcactcctttagaaaaggaaaaaacaggaaagttcaaaaaaagtaatctcaagctaaatacttgagattactttttattcatttttaattaaagcaatgcagccacttcatcgctgatttcgccattgtgataaacgttttgcacatcatcacaatcttcaaggcggttaattaaatccaataattttggtgcggtttctgcatcaagttgaacagtggttgatgggatcatcgtcacttctgcattttcaactttgaaacctgccgcttcaatgccatcacggacagaacctaagtcttcccaagcagtatagatctcaaatgaaccatcttcttgtggctgaatatcatcagcacccgcttcaatcgccgcttcagttaatgcgtcttcgtctgcacttgcgattaaaattaaaccttttttgctaaataaataacccaccgaaccttcagtccctaagttaccaccacatttagtaaaacttggacgtacttgtgagattgtgcggtttgcattatcacttaaacactcaaccattaccgctgtaccacctggaccataaccttcatacactttggtttccatattggtatcatcgccaccgccaacaccacggtcgatagcacgattgatggtatcacgtgtcatattattcgataacgctttatccacagctgcacgcaaacgtgggttagagctggtatcgccaccacctaattttgccgctgtcactaattcacgaattaatttagtaaaaattttaccgcgttgagcatcttgtgctgctttgcggtgtttaatgttagcccacttactatgacctgccattctcttgtttccttctttattatgttttgaaaaaatccccctctttagcaaagaggggttaggagagatttggtagaactgcttctcgctcataagagaatttgacattgctatcaaatctcccccagcccctcttttctaaagaggggagttgcttgttaaatattttgcaatcgcttcggcattattaggtgatttggtgagtgccaccgcatcatttaccgaaagccattgatacgctaaatgttccgtcaatatcggttcgatttcatcgggtaatcccaataaaaaccaatgttctgtattatgcgtaatgtcaggggcgtatttataacggaattgcggaaaaatctcaaatttcacactcgttttgcaatcataaagtgctaaattttgagcaataatatcaattctcacttcttctcgcacttcacgcaatgccgtttgataaggtgtttcccctgtttcaatcgttcctgttaccgactgccaaaaggttggatcatcttggcgttggagcattaatactcgctgagtttttttggcataaatcaccacgagaacagaatagggatttttgtagttcatttttatgtactatacaagagtttttacatcggatatgtgcgctcgacctttatcgtttatggtttttcagcatgtgctagaacattgtaaaatttcaaagagtaaataacaagattagatactgaaatgaattgattagtcaaatcgtgcgatttttttctgagaaatgaatgcttaaatttatgctaaagcggtgagattttcataagaatacgatttcaaatttcccttatatcaatttttttgttatcctaaccacaatgtaattgaatagacttatcttatatgaaatttattagaaaaaatgctgtatcgtgcatcatgttaagtagtttttatctataagcacttatgcaaatcccttgaaaaccatcttacagcagaatttatcaaatgcacctgaagtgaaagaagcacttgcaaacgttgaagctgctcagaattgtgttgaacaaagtaaatctcaacattttcctattgttagcgtaacaggttcaaaaactttaagacagtatcataagtatgaagataattatggttcaaccaaaatcatccctggtattcaggctgaaatgaatatctttgcttttggcgctattgagaaagatattgaacgcagttataaagagaaggagtactataagcatacctataccgctactcaagaggaaatagcgtatactattggacaactttatttaacggcactgaatatgaaggaagccatttctgtaatggaaaagagcttatttcgccaccagcaaattttacaggatttggatattatcatggagaatgatgaagggcgagaatccgaatttgttcaagctgagacacgtatgttgatggctcaacaagaaattaataattatcgacaaaaattattagctactttgaatacactatcaaaatatacaaggactaaagttgttgaagaacaattaagtgatcctttccttcagttgaaggaagaacagctttctccttctttattttttataaataagaaggagaatgtttattttgtcacatatctatgattaatttattctttctgtattggttaatatggttatgttgacatctactctctactcatatttagttcttgtgggagtgaagctagtaatcatatagataataacttattcattaatatgtgtcttctttatataatattgtcgataggtagaattaaggacaatgcaaatatattacccaaattatcaaggatctgaccgcttgttagatctcacctccccgaaaattatggggattttgaattttacccctgattcgttctccgattcgggcaaattttttacccttgataaagccctgtttcaagtggagaaaatgctcaatgacggggcggatattattgatattggtggtgagtccacccgttcgaatgcagaaattgttacccttgagcaagagttggaacgggttgtgccgttggttgaagcggttcgcaagcggtttgattgtttgatttcggtagatagctcaaaggcggaagtatttcgtcaatccgcacaagttggagcggatattctcaatgatattcgtgcgttacaagagccgaatgccttagaaactgccgtagaattaggtttgcctgtttgtttaatgcatatgcaaggcacaccgcaaaatatgcaacaaaatcctgaatataatgatgtggtggaagaagtcgcagattttctcaaccaacgcatttttgcttgcacaatggcaggcattcccaaagagcatattattttagatgttggctttggttttggtaaaacggtacaacataattatcaactgctaaaacatctaaatgcctttgtagcttcgggctatcctgtgttagctgggctttcccgtaagtcgatgatcggcaatgtaatcaataaaccagtcgatcaacgtgtagcaggcagtgtcgtaggggcattgctcgcagtgcaaaatggagcgaagatcgtgcgagttcacgatgtagcggaaaccgctgacgcgttgaaagtgtggcaagcgatgaatgaatgtgaataaaaatggaagataaaatgacaaaaatctacggcattaaaaactgtgataccgtgaaaaaagcgatcaaatggcttgcggataacgacttaaacccacaacttcacgactaccgtgtcgatggcttagatcctgtttggctggctgaaatggcagagaaatttggttgggaaaacttagtcaataaacgtagcaccacttggcgtgggcttgatgatgaaatcaaaaataatctcaccaaagagctggcactaaaggtgttaaacgaacagccaaccttaattaaacgccctattgtgattgctgatgatgctgcgttgattggttttgatgagaaagagtatcaaaaggtatttatgaaatgatacccaacatattaattatgttgagtaaaagggggcaattttaagggctctctgtttattcaaaggtattggataggatttggatcatgagttatattgtagctcttactggcggtataggaagtggtaagtcaactattgctaatctttttgctgcacttggtgtgccagtgattgatgcagatattattgctcgaaatatcgttgagaaaggcagtcctttactcgctcaaatagtagctcattttggcaaacaaattttgtttgaaaatggtgagcttaatcgtacagcattacgacagcggattttccagacagaatatgagagactgtggttaaatcagttacttcatccagctattcacacagaaatgttaaagcagttgaatgaaagccaatctccctatgtgctttgggttgttccattattgattgaaaaccagctaatggcattatgtgatcgtattttagttgttgatgtattgcctgaaattcagctagaacgagctatgaagcgagataaaagcaatgttgaaatgataaagagtattatgctatcacaggttgatcgtcaaacacgattaaactatgctaacgacgtgattgaaaataatttaccttttggtgataatgaagtccatctgactcatcaagtggcaaaattgaatgaatattatttgactctaagtaaaacaaaagggaaatagatcatgctcgtcgtattctgtccaaattgtggcaaagaagtggcttgggttttgggcaataaatatagaccattttgcagcgaacgctgccatttagttgatcttggtgaatggctcaatgaagaaaatcaagtccttgaaagtgatattcagtctgcagatgactatgatatagtggtaagtgagggtattttctaatgaaataacaaactaaactgttcaataccttgccaagcctcatcactaaattcttgttttacctgtttttctaattcggcaagggattgaataagtttatacagtttatggtaagttaaacgttgcacggcagcttgataaaacccacggcggttttgccatactttcaagcggtcaaattcggttcgtaaattaccgctatacaaaggttggtgactattgataatcggctgtggtgagcgagtcatttccagtaataaaagtagctctttttgtacgatgcgtagcaacaccactggttgtatctcttcattctgcagatgttgaagcactcttaatgctcggttaattttgccttctaataaggcatcaacccattggaatggggtgaattgtgccgattgttcgatcacttcttttgctcggtttaatccaatcttttgttcagcaaaacgaagttgtaacatctgcaatgcttgttttagtgccagtagattgccttcgtagctataacaaagtaattgaatagcatcaggctcaagctgcaactgcattgttttagctcgatgttgtagccaaataggtagttttgtaatatctggtgtttgacagtttacgactacggcattatttagttgtacaaaccagctctgtttttccattgctttggttagttttggttggtgcagaacaaaaagtaaatccgtgtgagaaaaagccagtagttcagatagctgtttttgctgtgttacagtttggttttcaggcaggttaagaattagaatttggcgattaaaaaaaagcccatttgattgaacgaggtcaaacaacatatcccattgggtatcattggcaatggtaaactcttgtttttcatcaaaatcctgtaaacgagccgtttgtacaatacagtcttttgcttcaccaaccaataaaagatcctgccctgtcaataaataaaacggctgtaagcctttattgagggcaggttctaatccttctgggaaaatacgttgcatcatcttatttcgtatttgctaactctttttgtaatcctgcgactttaataagaagttggcgagaggcttgttcatacatttgacgctgaatactttcttgctcttctgatttcgctaaagcggcacgagagtcatcgaagaatgtacgatgaacgctagtttcaatcggatatatccctttatttggtattgttaccgttgcttttacggttaagctaaggattttttcagcttcacgcgcttgtttaaagactgatgcaacacgagattcactttctgttgcatttaaacgtaaattcgcaacgttagtagatttcggtacgatttgaatgttactgagtaacattttgttacgcaaaatgcgtgacatatcgctgtattggtccgcactttcaaaactcagcgtacgcaattcttcagggaactgttcattatttttaaaatgccaaccgcaagcggttaaaaatagcacacaaatgagagagagtttttttaacataccatattcctattttgtagggtgggtcttgacccaccatatacgatgtagattagatggtgggttaaaacccaccctactattatgctttcaccgcaaaactcaacatcttaaacggtacatagatctctttcacgatttctacgccttcaagatatttcgccacattttcatcggctttcgcaatcgctttgacttcatcttccgttgcggttgcagatacagtaattttaccacgcactttaccatttacttgcaccacaaccagtttttcatcttctaccattgctttttcatctgccacaacccaaggtgcaaagtcaattgaaccctcattgcctaaggcttgccatagttcaaagcagatatgcggggtgattgggtagagcatacggatcaccgcatttaacgcttctgccattaccgctttgtcttgatcattaacaagcggtgctttggtgagcttattcatcaattccataattgccgcaattgcggtattaaaggtttgacggcgaccgatgtcatcactcactttcgcaatggttttatgtacgtcacggcgtaaatctttttgctctttgcttaatgccgtaggatctaatgcaacagtggctggcgattgtgcatactcataagccaagttccaaagacgacctaagaaacgtttcgccccttctactccagactcttgccattctaatgtcatttccgcaggggaagcaaacatcataaatagacgcaccgtatccgcaccatatttttccaccatttcttgtgggtcgataccgttgtttttcgatttcgacattttggtcataccgctgtgtaccaacgcacgcccttctttgtcaaaggctttcaaaatacgccctttttcatcacgttcaactgtcacttctgttggcgacacccaaatacgttcattggttgggctggtgtagtaataagcgtccgctaacaccataccttgacagagtaatttttctgtcggttcatcgctagtcacgaaaccggcatcacgcaataatttgtggaagaagcggaagtagagcaagtgcattgttgcgtgttcgataccgccgatatattgatccacaggtagccagtagtttgcttcttctttgtctaacataccttgttgatattgtggcgacgcataacgtgcataataccaagaagactccataaaggtatcgaaagtatctgtctctcttaacgctggctgaccgttataagtggttttcgcccattctggatctgctttgatcgggcttttcacgccgtccatcaccacatcttcaggtaacaccacaggtaaatcttgcattggtacagtcacagtttcgccattttcaagggtaagcattggaattggcgccccccagtaacgttggcgagaaacgccccagtcacgcaagcggtaattaacttgacgtttaccgatccccattccttctaatttatccgcaatacctttgaaagcgccatcaaaatctaagccatcaaattccgcagagttaatcaatttaccgtgttcagtcattgccgctttgctgaaatcccattcagaaccatcaagcggtgcgatcacctgtttaattggtaaattgtatttttgtgcaaattcaaaatcacgctcatcgtgagcaggtactgccattacagccccagtgccgtagtgcatcaacacaaagttagcgacccagacaggaacttcttcgcctgttaaggggtgaatagcaaacaaccctgttgccattccttttttctccattgtggcaatatccgcttccgccactttggtgtttttcgcttcttgaataaaggcagctaatgcaggattgttttctgctgccagggttgctaatgggtgggccgccgccactgccacatagctcacaccaaagaaagtatctggacgagtagtataaacaggcaaggtttgatcagtgcctttcactttaaaagtaatttcaaccccttcagaacgaccgatccagttgcgttgcattgttttcacttgatctggccataacggaagacgatctaagtcatttaacaattgctccgcatagtcagtaattttaataaaccattgcggaatttctttttgttccacaggggtatcacaacgccagcaacagccttcgtggacttgctcatttgctaacaccgtttcatcattcggacaccagtttactgtcgatgttttcttatatactaagccttttttgtacaattcagtgaagaaccattgctcccatttataatattcaggacggcaagtggtcacttcacgatcccagtcaaagccaaaacctaaggccttgagctgatttttcatatattcaatattttcataagtccattttgctggtgcagttttattttttaccgctgccccttctgcaggcaagccgaatgcgtcccaacccattggttgtaacacgtttttgccgttcatacgttgataacgggaaaccacatcgccgatcgtatagttacgaacgtgtcccatatgcagacgacctgacgggtatgggaacatagataaacagtaatatttcggtttgctttcgtctttaattgctttgaatactttattttcagcccagtactgctgtactttaggctcaatcgcactcggattgtattgttgttgcatcatcttcattcctcaaatttgtcgaaaaattgcggtatagaatagcgtaaaaatggggatttttgaaatgatattaagttcgcggtataaacaaaattaaatagtgaagcaaactccgtagatgtaaattagtcatttgttcgtattttaggctatgtcagcaaaggctaaagccccagcaaaattacctgatcgagaaaatctcagggaaattttggcttacaacattcaaacgttgcgtgtgcaaaaaggttggtcacaggaacgattagcgaatgagtgtgagttagatagaacttatgtttcagcggttgaacgttgccgctggaacgtttcgctttcaaatattgaaaagttagcaactgcactttcttgtccagcttggcagttattgaaatacccagaaaatagcaatcaaaatactgaaagaaatttagatttgtgttaaaattcgctggctttttcgtccgcccgattgttagggcgagtaaagcaacttgcaaaaaattttgaaaaactgaccgcttgcaagcggtcttttgttttgaaaaatttacgaatttcaatgatttacacgtagggacacactgcgtgtgtccgttctattttgtattgatgatatttagcagacacacgcagtgtgtctctacgggaataacataaaccaacaagtaacctttcgtatgggttaccactgtataaggattaacaatgccaattattactttacctgatggctcacaacgccaattcgacaacccagtttctgtgatggaagtggctcaaagtatcggtgcaggtcttgcgaaagcaacaatcgcagggcgtgtaaacggtgaacgccgtgatgcttctgacattatcagcgaagatgccacccttgaaattattaccgcaaaagatgaagacggtttagagattatccgtcactcaacggcacacttactgggtcacgcaatcaagcaacttttcccgaatgtgaaaatggcgattggtccgacaatcgacaacggtttctattatgacattgatttagaccgctctttaacgcaggaagatcttgatgcacttgaagcgcgtatgttggaactggcgaaaaccaattacgatgtagtgaaaaaacgtgtgagctggcaggaagcgagagatacctttgaaagccgtggcgagtcgtacaaaatggcgattttggacgaaaatatcagtaaagatgaccgcccagcactttatcatcacgaagaatatattgatatgtgccgtggtccgcacgttccgaatatgcgtttctgccatcacttcaaattacaaaaagtggctggcgcatactggcgtggcgacagcaaaaataaaatgttgcaacgtatttatggtacggcgtgggcagataaaaaacaacttgccgactatttacaccgtttagaagaagcggcaaaacgtgaccatcgtaaaatcggtaaagcgttagatttatatcatatgcaagaagaagcaccgggtatggtgttctggcacaatgacggctggacgattttccgtgagcttgaaaccttcgtgcgtaccaaattaaaacagtacgattaccaagaagtgaaaggtccatttatgatggatcgtgtgttatgggaaaaaacaggccactggcaaaactatggtgatttaatgtttaccactcaatcggaaaatcgtgaatatgcgatcaaaccgatgaactgcccaggtcacattcagatcttcaatcaaggtttaaaatcataccgtgatttaccgttgcgtatggcggaatttggttcttgccaccgtaacgaaccgtctggttcattacacggtttaatgcgtgtgcgtggctttacccaagatgatgcccatattttctgtatgccagagcaagtagaaagcgaagtcacatcgtgcattaaaatggtgtatgacatttacagcactttcggttttgaaaatattcaagtgaaactctcaactcgccctgcaaacagtatcggtacagatgagatgtggaacaaagccgaagcagacttagcagccgcattaaccgctaacggtttagcttttgaaattcaagaaggcgaaggtgcattctacggcccgaaaattgagtttgccttgcgtgactgtttagatcgtgaatggcaatgcggtacgatccagttagacttctttttaccagagcgtttaagtgcatcttatgtggcagaagataacaaccgtaaaacacccgtaatgatccatcgtgcgattttaggctcaatcgagcgtttcatcggcattatcaccgaagaatacgcaggtttcttccctgcgtggttagcaccagttcaagcagtcgttatgaacattaccgacagccaagcagaatacgttcaacaagtggtaaaacaactttctgatgctggcttgcgtgtgaaagcagatttacgcaacgaaaaagtgggctttaaagtgcgtgaacacaccttacgccgtgtgccttatatgcttgtttgcggtgataaagaaatcgccgaaggcaaagtgtctgtgcgtactcgcaaatgtgcggatttaggtacttacaaagtagaagagtttgtcgaaatgctcaaaaaacaagtccgcggacgtgagttgaagttacttggggaagagtagtcagtttagatacactaggaggccaatgtagaggagagtaattctcctctcattactaataggcatagtagacaaaagtattggttttaattattttccctaattattaccaactctttttatttaaaaatcctttataaacataatcttacgctttttcgttaatccgctatgaaccgataatttctgtttcagttctttaaataacccttccaacctatttgttgttttttctatatttaaatgagtatattcttcaaaagtgagtttaaagccttgtactataaggctttagcccactttttaccaacacttttgtctactatgcaaaatatcctatctaaatcaccgctttcattagatttccgcctattatttctaacttttattgataaacgttgaaaaattcttgttattttattcttagttttgtgtaactcttgttttttttttttttttacaatagcgtgcggggacatttgtacatcctgaaaatgtaaataaaggtttacgatgttttattaggaaaaaacagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatggggggcatttgtacatcctgaaaatgtaaataaaggtttacgatgttttattaggaaaaacagtagagaaggttattatgaataaaatatttagagttatttggagtcatgctcaacaggcttgggtagttgtatctgagttagtaaagtctcacaccaaaacatccgcttacacggataaaagagctcaagtatgcacctcagattattttttagataaacagcaagataaatttaaattaagtcttttaagtctagtattactaagtatattttttaatccagtaggtttagctggaccatatcttcaagatggtgctactacatcgaatggatctgacgaaggtactattggtattggtaaagagagtaaggcttcgtatggtgctgttgctatcggtcagaagtcaaaagctgaagctaggcataatattgcgataggttttgaagcagattcaggaacagacgcaaactctattacgataggctacaatactaaagtaattggggagcaagcaattgccatcgggaaagagtcaaaagcgggagggagatctgttgtcttaggcggacaagccaaggggacaagtactcaaacagttgcaataggtaacttggctactgcaagtgcgtcacaatctattgctattggggcagatgccaaagcggaggggtatggctccatatcaatcggtggagatgatttagatcaaacggattatcacgctaataatgctaataatgctaataatggaagctcccgccgcacaacaactgcgaaaggtaaagcctctgttgctattgggggtctgtctttagctacgggcgacggatctattgttttaggtcctctagcatctgcaagtcatactgaaggcattgctatcggtgcgagaagtaagtctaccaatgagtacggtattgcggttggtggtagtgcaagtgctgatggaaaaaacgccgttgctcttggtaaggactcgaaaggtactggggaagattccattgcgataggtaattctgcgaaaacaacaggggcagactctgttgttgtgggtgccaatatcaatgtgacagatggacaattagtggcaattggacgcgaagcaaaagctggaagccattctactgccttgggttataaagcctctgccggtggtatgcactctgttgctgtgggtgaaagtgccatgataaatgatggtgctgctagagcaaccgcacttggtaataataccgttgtcaccgtgggtggcggtgtggcattgggttatggctctaaggcagatacagctggcggtgtagtggggttaaaacaagatcattctgtcataacgggagcaagcactgtcgataacggctttcaatccacagaaaaggttgatggtaataataaaattggtgcggtttctgtgggtaataacctaatcaaacgccaaatcgtcaatgtggcggctggtaaagaattaaccgatgcggtaaacgtggcgcagcttaaatctttaaccctgaaaattgcaggcaataccagcgaacaaacacaaccagcggttggcttgtggagtggtacgctcactgtaaaaggagaaaatggtattacttcccatgctaagggcgatacgattacggttaaattaaccgaggatactaaacgcaaaattgataagattgacaatttaggttggaaacttgcaattactaaggaagcggggggtgaagcaacaaatcaacctgcggcacatcttatcaaaatggaccagaccgtaacctttaccgctggaaataatattaaattagaacaagcgggcggaaatattacgatttctacgattggtaagttaattaaagagactaaaatcctagcagatggtggtttgcaaattacttatacggatggcaagactgatactattgctaaggggaaagacggtaaagatggtgagaaaggtgatagaggggaaccgggtcctagaggtgaaccaggtattccaggacctgcgggtccagtaggtcctatgggtccagcaggggctgctggtctagtaggaccaatgggccctcaaggtcctgcgggtccacctggtcctgtgggtccagcaggggctgctggtcctaagggggataaaggcgaaccaggacaagcgggtccagcaggaccacgaggccctgcgggtcctaaaggagatgcaggtcagaaaggtgaaactggccctgcgggttcagcaggtcctagaggcgaagcaggtcctgctggagcaacaggaccacaaggaccgcagggaacagcgggtgctcagggacctaagggggataaaggcgatccaggacaagcgggtccagcaggaccacgaggccctgcgggtccagcgggtccaaaaggagatacaggtcagaaaggtgaaactggtcctgcgggtccagcgggaccacaaggtcctgcgggtccagcaggggctaagggtgacaaaggtgatacgggtccagcaggaccacaaggccctgcgggtccaacgggatcacaagaccctgcgggtccaactggaaattcggaattaaaaggcattacgtcgatagccaatggtaacgacgccaccaaggcgaatggggctaagattaccttgtctgcaggttctacaaataaaacagttaatgttaatgatgcgaaaattaccaatgtggcggctggtacagcagatactgatgcggtgaatgtgagccagttaaatactaaggcagcagcttcaaaaacagaggttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggtgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctggggcgatggctaatttgccacaaatttctttaccaggtaaaagtgctatttctgtttctaatgcacaatatcgcgggcaatctgcctatgctataggttattccagaatttctgataatggcaaatggcttattcgagcgtctgttagcagtaatactcagcgggatactatgattggaggaggggtaggttttgtgtggtaatctagcacctataaattagaatttcatgctcaatgccattgttattttaacaatggcattgtttggcatagtagacaaaagtgttggttttaattattttccctaattattaccaactcttttgtctactatgcctactaatatagagtgctcacaaattcaccacaaatttcccaaccccaagatcatcttctttgcgagtacgattaattacactttgagcggattcaataacacgtaaacccatctgatcttcggttctcaccacttcaccacgcaatgagttggtataaacatcagtaattttaacatccacaaatttgccgatcatattaggtgtaccttggaaattgacaatacggttgctttcagtacgtcctgttaattccataatgtctttcttagatgggccttcaactaaaatacgttgttctgtgcctaacattgcacgactaaattgcattgcttggttgttgatacgttgttgtaagcggtataaacgctcttttttctcatcttctgtcacatcatcaggcagatccgctgctggcgtacctggacgagcagaatagataaagctgaagctcatatcgaaattgacttgctcaatgattttcattgtttgttcaaaatcttcagctgtttcacctgggaagccaacaataaagtcagagctgatttgaatatcagggcgagcctcacgcaatttacggataatggctttatactccaacgccgtatggttacgtttcatcattgttaaaacacggtctgaaccactttggataggtaagtgtaagaagctcactagctcaggggtatctttatatacctcaatgatgtcgtctgtaaattcaatagggtggcttgtggtataacgaacacggtcaatgccatcaatcgaagcaactaaacgtagtaattccgcaaaagaacagataccaccgtcaaaggtttcaccacgataagcattcacattttgaccaagcaaatttacttcacgcacgccttgttcagccagttgagcaatttcaaatagcacatcatcaacaggacggctaacttcttcaccacgggtataaggcacaacacagaatgaacaatatttattgcaaccttccataatcgacacaaatgcagttggaccttctgcacgaggttcaggcaagcggtcaaatttctcaatttcagggaagctaatatctactactgaactttttccgccacgaatttggttaatcatttcaggcagacgatgtaaagtttgcggtccgaaaacaatatcgacgaaaggggcacgttcacgaatatgttcaccttcttgtgaagctacgcaaccacccacaccgataattaaatcaggtttatcttttttccagtttttccagcgaccaagttgagagaacactttttcttgtgctttttcacggatagaacaggtgttaagcagtaatatatctgcttcttcaggattttcggttaattctaaaccgtgtgtgctatttaaaaggtctgccatttttgacgagtcatactcgttcatttggcaaccccaagtggtaatatgtaattttgccattttcaaataatagataaatcagtaagtaaaaaaataaaagtagagttgtttatcctttggaacagggtgtaccttattttacatgtttgtatatatcatcgctataaaaaagaaaaccacgaccaaaactcgtggtttttattcaagtagtgtaactattttgttaaaactaaaacagtactttcacctgccacaacttctccagacaatttttgaagatttgttacttcatccatatttgaaattacaacaggtgttaatactgattttgctttagattgaagtaattcaagatcaaatttgatgataggatcaccaactttaacctcttgattttcttctgcaagacgtgtgaaaccttcgccttttaactcgacggtatcaataccgaagtgaacaaaaagctcaacaccatcttctgactcaatagagtatgcgtgattagtttcaaagattttaccaatcgtaccgtttactggggcaacaatcatatcaccagtagggcgaatagcaatgccatcacctacgatcttttccgaaaacacaacatctggaacatcttcaatatttacaatttcacctgaaagcggtgcatagattttcacttccttcgcaacagcttcttttttgccgccgaatagtttgtcaaaaaatcccataatttaatctccattattaaatgaacaaaattctcgcatattttatacgagaattttgtgtttgtattcaattttagttaaggttttggtaaaactcatcaactaaacgttcaatatctgttgctgttggttgtgcaagtgctttatctgcaagagctttggcatcagcatagttgatactgcgaacaagttttttcacatgaggtactgaaattgcactcatactaaactcatctaagcccataccaagtaatagcgcagttgcgcgcacatcacctgctagctcaccacacataccagtccatttaccttctgcgtgtgaagcatcaatcacttgtttgattaagttcaagacagatggggttaatgggttgtataggtgagcgataatttcattaccacgatctaccgctagggtatattgtgttaaatcgttagtaccgatactgaagaaatctacttcttttgcaaggtgacgagcatttactgcagctgatggcgtttcgaccattacgccaatttgaagatttttgtcaaaggctttaccttccaagtgaagctgtgctttaagttctgcaataatgccttttaattcacggatctcttccacagaaataatcatcgggaacatcactgcaagtttaccaaatgcagaagctcttaatacagcacgcaattgagtatctaaaatttcacgacgtactaagccaatacgaactgcgcgccagcccaagaatgggttcatctcttttggtaattctaagtatggtagctctttatcaccgccgatgtccattgtacgaagcactacgagcttaccattcattgcttcaacaatttctttataggcttggaactgttcttcttcaccaggtaactggttacgatccataaataaaaattcggtacggtataaaccaacgccttcgccaccgttacgcaacacgccatcaacatcacggatagtaccaatgtttccaacaacttcaatgcgatgtccgtctaaggtttcggctggtaaatcttttaatttagccagttcagctttttcgtccgcaattcttgcttgtaatgctttggctttttcaagctgttctgccgaaggattgatgtgaacttcattgttaatggcatcaagaattaaaatgtcacctgtattgactaatgaagtaatgttgtttgtacctacaacagcgggaagctctaacgaacgagccataatagaagtatgagatgtgcgaccgcccatatcagtaacaaagccaagcactttatctaagtttaattgtgcagtttcagatggagtgagatcgtaagcaacaaggatagcttcctcttggatatcaccaagatcaacaatattcatacctaaaatgttacggatcaagcggttaccaatatcacgaatatcaccagtgcgctcttttaggtattcatcatcaatttccgcaagcattgaagcctgcatatcaatgattttacttgcggcaacatcggcagttacaagattttcttcgatgtagcctagaatttcttcttctaattcttcatcttctaagatcattaaatgaccttcaaagattgcttctttttcttcgcctaacgtgcgtcttgccttttctttaattgctgtaagttgtgctgctgctttttcacgtccagtaaaaaatttacttttttcagattcaatttgagtgggtgtgattttatgtgtgttaagaacaataggttcttctttcagaactaaggctttaccaaatacaatacctggggaagcggcaatacctgtgatcataaattaatcctcggctagaatttagtagatgctaaatagcacgaaagactttaccattgaataaaatggtaaagtcatcaatatcaaaaggacaactactctaaagtagggattaaatctactaagaaatctacagctttctgttcgtcttcgccttcagcagaaagagtgatgatagttccttgcgcaagacctagggtctgaagtttaaataaactttttgcactggcacttttaccattagatgtgacagtaatatctgaagcgaagccttttgctgcttttacaaattcagccgcggggcgtgtatgtaagccattcgggcaagtgattgttacatcttttgagtacattgttggttcctctgttgtatatcaaataataaatggaggactttttagggaagagcctccaaagtaagtcacgggattactttactacaaaatcggtataaaaacacgataaaagagattaaataaatgataaatgtcaattattagtgtgtattttaatcaatttataaaatcgtttgcgtattttatgaattatgtgttttattttcttttttatagaattattgattgcaattacccttaaaatcttgtatttatccatactttcaattcaaacacaacttcaactttttaggagcataaaatgcaaaatgtaggttttatcggatggcgtggtatggtggggtcggttctaatggatcgtatggttcaagagaacgactttgcgaacattaaccctgttttctttaccacatcacaagcgggtcaaaaagcccctgtttttgcaggcaaagaggctggtacattaaaagacgcttttgatattgcagaattacaaaaattagacattatcgtgacctgtcaaggcggcgattacaccaacgaagtctatccaaaattaaaagcaacaggttggaatggttattggatcgatgccgcttctgcactgcgtatgcaagatgatgcgatcattgtgttagacccagtaaaccaacacgttattaccgaaggtttacaaaaaggcattaaaacctttgtgggcggaaactgtactgtgagcttaatgttaatggcaatcggtggtttatttgagaaagatctcgtggaatgggtgtctgtggcaacttaccaagcggcttccggtgcaggtgcgaagaatatgcgtgagttactggtacaaatgggcgagttagaagatgcagtaaaagcagagcttgcagatccagcttcatctattttagagatcgagcgtaaagtgactgcagaaatgcgttcagaagatttcccaacggcaaactttggtgcaccgcttgcaggtagcttaattccttggattgataaattactcccagaaacaggacaaaccaaagaagagtggaaaggttacgcagaaaccaacaaaattttaggtttaagtgcaaatccaatcccagttgatggtttatgtgtgcgtatcggtgcattacgctgccacagccaagcgttcaccatcaaactcaaaaaagatttaccattagcagaaattgaacaaatcattgcagctcacaatgaatgggtgaaagtcattccaaatgatcgtgaaacgacgttgcgtgaattaacaccagcgaaagtgactggtacattaactgttccagtgggtcgtttacgcaaactagcaatggggccagagtacttagcggcatttaccgttggtgaccaattattatggggtgcggcagagcctgttcgtcgtattttagtgcagttagttaaataatcttttcatctaatggaaggtgacttctattcttggtattcagataaaaaccaatggaacccaaaaatatataatagtataaaaaatataattaaagagttagagttttattcaagttcaaattttagttatgaatttcagacgatagatatttttaaagatttatatatggaaataatgcctaatgaaattaggcatagtttaggagaatatttcactccatcttggatggctgatcatgttgtatctcgctcacttgagaaactaaacaaagaatcttggaaagctatagatccatgttgtggaagtggggtatttttaatatcattaataaaatcgatactagataaacacgaattatatagtttaactataaaagaaaaacaagagttattattaagaatactatcaagtgtatatggtattgatttaaacccactatcagttttaactgcaagagttagttattttttggctataagaccattaattgacgaacaaaaaatagaaatccctgtctatcttggtgattcagctaatataccacaaaaaattgaactcgataatatagcttgttatacatataccgtagaaacaaaacaaggggattttaatattatttttccttgtaattttgttgaaagtagttctttttttgaaagaatgtatcgtttacaaacaacagtagaagctgaagaccctaaattattataccatcaaattattgaaaatatagataaagactctatcaataacaagatcaaacaaagtataaaaatattgtcaagtaaattggttgaattacataaaaatgaatgggacggtatttggattagaattacatcaaactttatgctaattgcaagagttaaagagatggatctaattttaggtaacccaccttgggtaaaatgggaatttttaccccaaaattacgctgaaaagatcaagagtttgtgtattgatagaaaattattctcaggtcaaagttatatgggagctatatcacttaatttatgtgctttaattgcaaatgttacatcagataaatggctaactaataaaggcttactagcattcttaatgccaaaaacaattatgactcaagattcttatgctggtttcagaaatttttatttatctgatggtagtcgaatgtatttaagtgaaatagatgattggtctaatgctggaaacccttttattgtaactaccgaaaagtttatgacatatttttatgaaaaaaatcctgtagattactcaaatgggatacctataaatttattctataaaaaatccaatgtgaaaatcacagaagtaaatagatttcatacatttgaaaaagtaaaagatttctttcaaattaaagatggaatggcttatcaattaagcgaaaatagaacgggatttactttactccctgaaagagattatacaattttaaggaagctaaagttaatttctggaacttcagattataaagctaaaagctaggagtggtgttgagtttacgcctgctgaggtttacttcattgaacctgagaaaagaaccagtaaaaacactttttattttagaaactctgaattcaaaaattcagtttacaaagtggctaaaaactaaattcacattttaaatttatataaagtttggaggtgtttaagcgatttcaatgcgccgccatttgaatgtgaactataagaccgattttgtcctttgccataaattacgtgaagtgccattcaaaactcgtgatttaagcccattacaaggtgaaatcctcgcagatggtgcctaggttaattttaattgtgcaacactaacttcgccaaaaatcgctataaatagtaacaaaaagccgataaacaatggcgaaaatttccaaagttcaggcagactaagcgttgtattatcagtctcaatcaacgagctttcaatgatgattgtggggttcaaatggaactattgtggcgatgaactatactgaaaatgccagaacaattttagcattaaaccaccaattcgtgaaacaaggtggtaatattatgtgtgatgaaaatatggcgtatcaaacctatataccaaaaaacataggctaacctagtaaattctcatataatataagcatctttaactatttatggactatttatgataatatcatccccccttatagctattgtctctggtgaaatctcaggcgatattttaggtgccggattgattaaagcactcaaagtacattatccaaatgctcgttttatcggcgttgctggtgagaaaatgttaaaagaagggtgtgaaaccctgtttgatatggaagaactggtggtgatggggcttgctgaggtagtgagacatcttcctcgtttacttaaaagacgtaaacaggtgattgatacaatgctggcattaaaaccggatatttttatcgggattgatgcccctgattttaatcttggtgtagaagaaaagctgaaagcccaaggtattaaaaccattcactatgttagtccgtcagtgtgggcgtggcgacaaaatcgtgtacataaaattgctagtgcaaccgatcttgttttagcctttttaccttttgaaaaagccttttacgaccgttttaatgtcccttgtcgttttatcggtcacacaatggctgatgcgattgcgttgcaacctaatcgacaagaggcttgccgtttgttgcaattagatgaaaaccaacattatgtggcgattttggttggaagtcgtggaagtgaagtgaatttcctgtctgaaccatttttaaaaacggcacaattacttaaagctcaataccctgatgttcagtttttagtgccgttggttaatgaaaaacgtcgtgaacaatttgaagcgatcaaagcacaagttgctccagaattagaggtgataaccttagcaggcaatgctcgtgctgcgatgatggttgccgaagcaacattattagcatctggcactgctgctcttgaagcgatgttgtgtaaatcgccgatggttgtaggttataaaatgaagcctttaacctattggttagcaaaaagattggtaaaaaccgattatatctctctgccaaatttacttgcaaacgaaccgcttgtcccagagcttattcaagcggattgttcccctgaaaatttagcgaaacatttgagtatttatttatctcaaatgcccgaagatgtggctcggaagaatgcgttgaaacagcgttttatggaattacatcaatatattcaatgtgatgctgatgctcaagctgcacaggctgtggttgatgtcttgaatagagagtaaaaacgggcgatttttgcccgttttatacaaaatcaataatcaacaagtgattgttgatccgcaccctctttctctactacaggctgaatcatatgctcacgtttcaagcctaattcaagagcaacacctaccgccacataaatagacgagtaagtaccgaaagcgataccgatcaataatgccagtgagaagctatgtaatgttggaccacctaatagataaagtgagaataccacaaatagcgttgtaacagaggtcatcaatgttcttgataatgtttggctcagtgaaatatccacaatttcgactgaatttgctcggcgaattttagggaaattttcacgaacacggtcaaataccacgatactgtcgtttaaagaataaccaacaacggataaaatcgcagccacgaaagtaagatcaatttcaatctgtaagaatgagaaaagaccaatagtcaccattacgtcgtggaacaaggctaaaatcccccctgttgctaaacgccattcaaagcgaaggccaacgtaaatcagcaacattgcaagggttgctaatgtgccgtaaatcgccccttgggttaattcttcaccgacatttggaccaacgaactcaatactttgaattttagcttctggatctaatttttggtgaattaaatccattaccgtattccccaaagacatatcgccagccgaagcaggtaggcggatcattacatctttttgtccaccaaaggtttgaactaaagcactggtataaccattttctgttaatacttcacgaacctttgccaaatctgcaggctgtgaaaagttggtttcaattactgtaccgccagtaaaatccaatccccagttaaaccctttagtcacaatggtaaacacacaaagtgccgtaatgatcaatgaaaatacatacgcaatgtagcggtatttcataaagggaactaatttataaggtagtttaatctctacttctttttctgttgtttgaacagtcatttaattccccttagatccaaagttttttcacacgtttaccaccgtaaacaaggttcactaacatacgagttcctgtaattgcggtgaacattgagatcattacccctagtgcaagagtcacagcgaagcctttgactggacctgttcctactgcataaagaataatcgcaactaatattgtggttaagttagagtcgaagatactggtgaatgcaccattatagccttcgtgaattgcctgctgaatagaacgaccattacgaatttcttctttaatccgttcataaatcaatacgttagcatcaattgacatacctacagctaacacaatccctgcaataccaggcattgttaatgtagctccaattaatgacatcaacccgatggttaaaactaagttagctaataaagcagctgtcgcaaataggccgaagactttgtagtacaccacgcagaataagatcgttagacctaaacctaacatacttgcgtccataccttgagcaacgttatctgcacctaatgaagccccgatagttcgttcttcaacaatcacaatcggtgcgatcaaagctccagaacgtagtaatacagcaaggttttgtgcttcagccgcactattaatacctgtaatttggaatgagctacctaaacgagagttaatggttgcaacgttaatcacttcttcgtgtttttcaagaatcactttcccgtttgcatcacggcgacctgaatctttaaactcactataaagggttgccatcggcttacctacagcagattttgtcgcatttgacatcaaatccccgccttgtgcatcaagattaatactaacattaggcaaaccacgttcatctttgcccgaagttgcattaataatatgctcaccacctaaaatggttttgcgatataacaccgtcggcataccatcacgactatatttaatctccgaatccgcaggaacaataccacgagccgcagactctaagttagcattaccattgactaaacgaaattcaagagttgcagttgcccctaaaatctctttcgcacgagcggtatcttgcacccctggaagttcaacaacaatacgatctgccccttgacgttgaatagtcggctcagacacaccaagttcttccacacgcttacgcaaaatcgacaagttttgttcgatagctaaatcacgagaagttgctaacccctgagcagattgagcaaaacgcacaacggttggagaaatataagttgcttctaaattaggattagtacggcgaatataacgaactgctttatctgcagtatcggtatcattaaattctacatctgttgcaaaattttctgcttttttaaccgctttgtattgccatttttccttacgaaaatcgttacgcaaggtatcttgtagctgatcttgctgtttcgccaatgccgtattcatatccacttccattaagaagcgaacaccgccacgcaaatccaaaccacgcttcatcggctcaccaccgattgaagttagccattctggcgttgcaggcgcaaggtttaaagcgacagaataattattgcctaagacttcagcgattttttccttagctggaagctgttcctcgtccttatttaaacgcactaaaatcgaaccattttcaaggttcatcgccttaggcgtaatatttaatgaagcgagtgctgattgaacttgcgtcagcgtttcatctgaagcttgttgccctctagtaccggaaacctgtaccgaagggtcttcaccatataaatttggaagggcgtataaaatgccaatggcgaccacaaggatcaccattaggttcttccaaagagggaaacggtttaacacgataagtcccctttcttaaaggaaaaaattaaagagatttgagtgaaccttttggtaacactgcaactacgaaatcacgtttgatagttacttcggtagtatcgttcaatgcgatcacaacattatcattatctgcagttactttagtaattttaccgattaacccaccgcttgttagcacttcatcaccttttgataaacctgctaataattcacgttgttgtttttgacgttttgcttgtggacgataaatcataaaatagaagataagaccgaaaacaaccaaaataaagatcatttccattccgccgccttgttgcatataaagctcctttaaaattattaactaaatttagacttcatctcaacattgagataatcactcactaaaataacataaaatctaccgtttaacgagtggaaattcagacaaatctactgatcggctttgtttctgttaagttttaggataatctcacaaagtattgtgtcaaatcattgaaattcaatcttaacaaggaaaaaagatgaaaaaaatcgtattacaagcggcagtatcttgcctatttcttacaaatgttgctttcgcccataatgtacaattaaaccaaacgttaccaagtgttaccgttcaacaagatggcgaattaattgccaatggtaaagaagtcgattatcgccaatggcaatcctctagcctagctggaaaggtgagagtagttcaccaccttgctggcagaagtagtgtaaaagagaaaaatcaaccattaatggacgcaattaaaaatgcagggtttgatcgcagtaaataccaaaccacaaccattattaatgcagacgatgcgattgttgcaacgggagcatttgtcaaaaatagtgcagaaaacggtaaattggaaaaccctcactctcaagtcattcttgatcaaacaggtagcgtgaaaaatgcgtggaaactaaaagagaaagagagctttattgcggtattggataaaaacggtaaagttcagtttgttgctgaggggaaattatctgatactcaaaaccaacaaattattgaattagtgaacagattaatttcccagtgatagataattccacaaatggagaaaaatggtgcaaatcgcttctagtgttacactacaagcgatttgttatttcaattattttacgatttattttgtatccaattgtgggatcacattattctgaacagaaagcaaacctgcctgtgtataaatacctaatttaccacgcgtatccacaatgtctaaattacgcattgttaattgaccaatacgatctgctggggtaaacggtgcatcttctactttttccatacttaaacgttctggttcataggttaagtttggtgattcggtattcagaattgagtaatcattgccacgacgtaattctaaagtcactgtgcccgtaatcgctttcgccacccaacgttgtgctgtttcacgcaacattaaggcttgcggatcgaaccagcgaccttgatagagcaagcgacctaaacgtaacccattgatacggtactgttcaatcgtatcttcgttgtgaatacctgttactaaacgctcataggcaatatgtaataacgccattcctggtgcttcatagataccacgagattttgcttcgataatacggttttcgatttggtctgacattcctaaaccgtgacgaccaccaatgcggtttgcttcaagaataagctctactgcatcttcgatacgtttaccatttaatgcaacaggcacaccttcttcaaaggtcacagaaacgacttcaggcttgatttcaaccgtttcgtcccaaaatgctacgcccataataggtttaacgattttaatgcctgtgctgagtaactcaaggtctttagcttcgtgagttgcccctagcatattagagtcagttgaatatgctttttcaacggacattttatagtcaaagccatttgtaattaagaattgtgacatttctaaacggccaccaagttcgtcaataaaagtctgatctaaccacggcttatagattttgagttttggattagttaataaaccataacggtaaaaacgttcaatatcattgcctttaaaggtcgagccatctccccaaatattaacatcatcttctttcattgcagcaacaagcattgtccctgttacagcacgaccaagcggagtggtattaaaataaggcacgccacctgtcgaaatatggaatgcaccacattgaattgctgcaataccttcgtgagctaattgctggcgacaatcaattaaacgagcattctccgcaccgtattccattgcttttctagggatagcattgtaatcatcttcatctggttgccctaaatttgcggtataagcataaggcacggcacctttttgacgcatccaaagtaatgcggcactggtatctaacccgcccgaaaatgcaattcccactttttgaccaagtggaagcgtttctaaaattgttgctgacataaaacttcctaatattttttgaatgaaattaaaaaattctcgcaatcttaccgattgcgttcaaagtccgatattctaacgcaaaagtgaaacacaatctattcaaagaaaaagaatttataggtcacaaaaaaacggtaagatgtattatcttaccgcctgtaaaatgcattatattaactatttaaattataaatagaatttctcaacaaagtttaatttgtcatcaagtttcaacactaacggctgaccggttgggatttcaaaatccataatttcttcatcagaaataccgatgatatgttttgccaacgcacggagagagttaccgtgagcagtcacaagaacacgtttaccagataacaatgctggtgcgatttggtcttcccagaatggtaaaacacgctccagggtgatttttaggttctctgcatttggcacaacatcttttggaagatgtgcataacgacggtcgttatgtgctgaatttggatcttgtggatctaaatccggcggagaaatatcataagaacgacgccaaatatgaacttgctcgtcaccatactgttctgcggttgcttttttgtctaagccttgtaatgcgccatagtgacgctcgtttaaacgccagtttttcacttgtggaatccaaagttggttagattcttctaacacgatgttacaggttttgatcgcacgcgttaaaacagaagtgaatgcgatatcaaattcataacctgcatcaagtaattttttacctgccgcttttgcttcttcaataccacgctctgttaagtttacatcacgccaacctgtaaataagtttttagcgttccactcactgaaaccgtgacgaataaatactaattccataagttctcctatataaaataaattgatttaatgtctatttataacaaaaaatacttttttttaaagttaaacacaattaatttgaagataaaaatgatctatgacaaaaaataagatgtaataatttattcctatgttggtaagaatgctactatttgcttattgcgagcatagggtatttaaaatctgtctcacccgctccaaatcctcagccgtatccaccccaacttgaggggcttctttggctaaatcgagatgaattttctcgccataccataatgctctaagttgctctagcgactctagctgttctaatgccgttggctcccaagccacatattgcttaacaaaacctgcacggtaagcatagattccgatatgacgaaggtagttttgttgttgaacaaaagcatcgtcacattgagggaaataatcacgtccaaaagggattgttgctcgagagaaatagagtgccattccgtttttatcggttaatgttttaaccacatttggattaaatagctcttctcgtgttgtcaatttaactgcaagggttgccatattaacttgatgtttatctaaattttcagccacttgtgccacaatcacaggcggaataagtggttcatcgccttgaatattcacgataatttcatcatctgcaatcgccattttttcaatcacttcggctaaacgttctgtgccagaattatgtttatctgacgtcaagcacacttctcccccaaaacttgtaacaacctgttcgatttcggggtgatcggtcgcgacgattacacgggtggctccagcttgttgtgccttttcccaaacgtgttggatcatcggtttacctgcaatatctaacaggggcttacgcggtaagcgtgtagaggcataacgtgcagggataatgacggtaaaactcataaaatctcctaaatgcgactaagatcaaatttcgctaaatcaatatgatttggcgtgccataaaattcacacaaggcttggcgaagttgttctgcacgtttgggtaagcctttttctgcatagattttaacttgttcataaacggcttgtttgaaagcagaattatcaccagcatcgcccgttaagttatcagcactggcaaaataacggaaatttgctgccgtagctaacacccattcaatcgcttgcggttttacttcgacttgttcaaattctctttggcgttcagcagagcgtccatcgggttcataccagtaaccaaaatcttctaatttacggcgttctgttccagcaactaaccagtgagcaatttcgtgtaatgcactgctgtagtagccgtgagcaaataaaataacattataagggcgttcactcgctacgttaccttcatcaataaaagcggggagataaatcggataatctccgccccgctctaaacgagtgttgtaattttctacaaagcaagcgtcaaagatacgaataagatcttcataatcgtgatcgttttggttcattgtaaatcctatttgagataacttacaaaatcagtaatttcttctgttttgctagcggtggcaatgctatccccctcaagtggcgagccaaccagcagtaatgcgacaatttcatcgtcagcttgacaaccaaaggcctggcgtaaagcctgtcctttaatccacttattggtaatccagcaagtttcaaagccttgaacgttggctgcaagttgcattgcataggttgcacagcctgctgtaaccatttgctcccaagcgggtactttgggtaaatcttttgctattttagcgataatcccgataaccattggtgcgcgtttagctaatttttctgcttttgtaacaccttcatcacccatttcaagttcttgagcggtttctaacaggcaacgacggaaaatttccattgccgttggctcaatcactacgaaatgatagggctttaaacgcccgtgatctggcgctctaactgccgctttaaacatattttctagttgttctgcatttggtacatcttgaccaaattttttacttgaacggcgacgttgtagtaaatctaacgtttccattgagtattcctcgtgataaaaaatgggtcaaaggatagcatattttgtttcgctttattttgttgattgtagggaaacaaggaggattggctatttatttaaaataattttttagatttagcgatcctaaaattgtttgctgtacactagcagtttgagcacattattgtatagcttaatattgagcttcaaatatcgtaaacgtttgcttaagatccaattttcattatttgatcttgatcacattttttatgtgagattttccgcaagttattctaaaaatagtgtaaacttatcaagtttttcaggtgatgatatagggtgattttaatcatcgattagtcgtctaaacactattcatttttatattgattaattttaggagtcgaaaatggcagaacgtagagaacttgcaaatgctatccgttttttaagtatggacgcagtgcaaaaagcaaattcaggtcaccctggtgcgccaatgggtatggcggatattgcggaagtgttatggcgtgattttttatcacacaacccaaccaatccagcttgggcaaaccgtgaccgcttcatactttctaacggacacggctcaatgttgatttatagccttttacatttaacaggctacgatctttcaattgaagatttaaaacagtttcgtcaattacactctaaaacaccaggccacccagaatatggctatgcaccaggcgttgaaaccacaacaggtccgttaggtcaagggattactaatgcagtaggtatggcgattgcggaaaaaaccttagcggcacagtttaaccgtgaaggtcacgagattgtaaaccactacacctatgcgttcttaggtgacggctgtttaatggaggggatctcacacgagacttgctcattagcaggaactttaggcttagggaaattaattgctttctacgatgacaacaatatttcgattgatggtcacgttgatggctggttctctgacgatactgcaatgcgttttgaatcttacggttggcaagttatccgcaatgttgatggacacaatgcggaacaaattaaatttgcaattgaaaatgcacaagcagaaaaagatcgcccaaccttaattatctgtaaaaccattatcggttatggctcaccaaacaaatgtaactcgcacgattgtcacggtgcgccattaggtgatgcagaaattgcggctgctcgtgaatacttaaaatgggaacacgcaccttttgttattccagctgaaatctatgcagaatgggacgcaaaagcaaaaggcttgctcgcagagaaagagtggaatgcaaaatttgcagcttatgaaaccgcttacccagagcttgccgctgaatttaaacgccgtgttgcaggtgaattaccagcaaactgggcgaaagaatcacaagcgtttattgaaaaattacaagcgaacccggcaaacattgcaagccgtaaagcatcacaaaatgcgattgaagcctatgcacacattcttcctgaatttttaggcggttctgcagacttagcgagttcaaacttaacattatggtctggctcaaaaccaatccgtgcagattacaatgttgatggtaactacatcaattacggtgtgcgtgagtttggtatgtcagcgattatgaacggtatcgctttacacggtggctttatcccatacggtgcgaccttcttaatgtttatggaatatgcacataatgcggtgcgtatggcggcattaatgaaacaacgctcattattcgtttacacccacgattctatcggcttaggtgaagatggcccaactcaccaaccagttgaacaaactgcggcattacgtttaattccaaatcttcaaacgtggagaccgtgcgaccaagtcgaatctgcggtagcatggaaagcggcagttgaacgtaaagatggcccaagtgcattaattttcactcgtcaaaacctagctcaaatggaacgtaccccagaacaacttgctaacgtggctcgtggtggttatatcctgcgtcaatgctgtgaaaaaggcgattgcccagatttaatcttaattgcaacaggttcagaagttgaattagcgatgaaagcagctgaggtattaagtgcagaagggcataaagttcgtgtggtttcaatgccaagcactaacgtgtttgacgcacaagatgaagcttatcgtgaatcggtattaccaagctcagtgaccaaacgtgtggcgattgaagcaggtatttcagatttctggtataaatatgttggctttggcggccgcattgttggtatgaatagcttcggagagtcggcaccagcaggtgaattattcaaactcttcggctttaccgtagataacgtggtagcgaaggcgaaagagattttgtaattacatagaatgtggcaaaataaggggattttatatccccttattttttagtttctatttgggaaatcagaaaatgaataaaattcttgttattcgtaacgataaaattggcgattttatgttggcttgggcggcatttgcgatgttaaaaaaatcaatgccgaattgccaaattattgcccttgttcctaaatatacagcaccattagcggaaatctgcccttatttagatggtattattttggatagttcagataaacaaaataaagctgaaaatgaacaagtgttacaagcggtaagatcagcacagtttgatgcagtgattagttttgtgtcggattggtataacgccaaattggtttggaaaagccgtattgtctaccgtttagcacccgcaacgaaactctttcaatttttatataatcatcgtttaacccagcgtcgttctcgttctgaaaaagcagagtataaatataatgtagacttagtgcgttattttttgaaagataatcaaattacagcggtagagccaacgacaccttacttatcttttgataatgcttgtctgagtacgcaaaaaagcaaattaatggaactgttaaagttagatggcaataaaaaatggctttttgtacatagtagtacaggaggatctgcgacgaatttatctttgaatcaatatgcggagttaattttagggattttagcgaaatttgattgccaagtgattttaaccgcagggccgaatgaaagcgaaactgctaaagcattgcaacagttagtaaatcataagaatgtggtgatttatgataaaaatgatggattagtcgattttgccagatcgttagcctgtgctgatctctttattgcaggttcgacagggcctttacacatttgtggggcattaaatattgcaacggtaggtttttacccaagtcgtttatctgccattccacgccgttggaagccgttaaatgatgccgataaacatatcgcattttgtccgccatctgataaggcttcgcaaaaaaatttaaccttaattccgatggataaagcattaatggagattctgccgtttatgagacaaatcatggataataaaaaattataggatagtaagtagtaatatgttttagttattactagtaattaaatgttattaatatagtattttttattgttacaatctatctacttttgaattagagaggctacatgcaaaaaagaatttttaattttatccagaaaaaatatttatgtactataagttgtgcaaggaataatattccttggtctaatgcattttattatgtatttgatgaagataatctgcgtttaatttttgtgacgagtttaacgacttatcatagtcaagtgatgttagagaatcctaatatttctggtacaatctttgtaccaacgcgttttcatccctctttacaaggtgttcaatttacaggtaaagcaagaaaattagagggggatgaaaaaaatattgctagagaattatataaaaaagaatattcacatgaacttattgataaattgtctatttgggaagcaaaattagagtatgctagattaattgataattcattaggattatttagtgtaatagaatggaatggggaagaatatttctaatatatagtttttatactttcaacatcatagattcttttgagaaataaatttattagaacataacagtatgaatataaaaattcttattactggtggtgcaggttttattggatctgcaatgattaggtatattattaataatactcaagacttagtaattaatatagataaattaacttatgcaggtaatttaagctcattagaggagatttctaatagttctcgttatgcatttaaacaaatagatatttgcgataaaatagccttagagcagatatttaatgaatatcagccagacatagtaatgcatttagctgcagaaagccatgtagatcgttctattaagaattcggaagtatttattaagactaatatttggggaacttatactttattagaagtagctcgtaaatattggaatgatttgccagaggaaaaaaaatctatatttcgtttccatcatatttctactgacgaggtttatggtgatttaggaacaagtgagaggcagtttacagaaatcatgccttatgctccttctaacccctattcggcatcaaaagccgcaagcgatcatttagtgcatgcttggaggcgtacttatggggtaccaactatcgtaacaaattgctcaaataattatggtccctttcattttcctgaaaaattgattccattgatcatcttgaatgcaatagaaggaaagaaattaccaatctatggtaatgggttacaagttcgtgattggttatttgttgaagatcatgcgagagctttatataaggtaattaaagaaggtagagtgggagaaagttataatattggtggtgatagtacaaaaagtaatctggaggtggtttatgctatttgtgaaatattagaagaactacttccacataagccaaaaggggtacagaaatataaagatctaatttcttatgtaccggatcgtctagggcatgatactcgttatgctattgattcaactaaaattcgcgaagaattagattggaaacctcaagaaacttttgaaagtggaattcgtaagacagtagagtggtatttaaataatcaaaaatggtggaaaagcataagaaaaaataatttttcgtattcttgttaaacaaaatagatattcattccttagcaacattctgaatgattaaacttaagaatacctttggttattttatcgctgtagagtgaatttgctaattactattttaacaaaagttattgaattttatcttctttcaaatacttatgttataaataagtaagcctatctattagtggatctttaaatataaaccctgcagattgtaatttgtgaggcacaagcggttgattatctaacaacaattgcgaacgttcacctaataaccattttaagatccattcaggcacagcaaaaaaggctgggcgtttaaaatgtcgagcaagtttttgattgaacgcagaattagtcagtagctccggcgacaccaaattaaaagcaccactacattcgaaatgattgagtagaaataaaattgcccgaatttcatcatttagcgaaatccaagcccagtgctgtttaccggatcctagttttccccctaaaccgaaacgatagagcggcaacattttttgtaatgcaccgcctgttttgtctaatacaatgcccgtgcggataagacaaactctcgttttatcactttgagcttgtaaagcggtcttttcccattgaaaacagagctgggctggaaaagctgtaccacaagcggtttgttcatcgtaatgttttccttccgccaaattgccataaaaacccgttgccgatcccgaaataaaggtgtgaggaggcgtatcgctcgcttgaattagctcgactaaacgctgggttatactaagacgactttgtattaatttttgtttctgtgctgtagtccaagctttgtcaaaaatcgactcgccagcaagattgatcaccgcatcgaatgtatttaaatgctggaaagcggtaagatcttggcaaaaacttaccgcttgttgattaggtaacctttggcgagtcagtacggttagctgatgtccttgcttaattaaagcctgacaaagtgccttgcctataaagcctgttccgccggtaatcagtatgttcattagagtgagctatcaaaaagttcagtaatggttgcaattaatgttgaaatagaggtatcacgagttggggtaatgaaaatcgtatcatcgccggcgatagttccaagtatgccttctgcttttcccattgagtccagtaatcgagcgatcaactgtgcggcaccaggacttgtacgaacaacaatcaaactttcattatggtcgatatcgatcactaaatttcttagtgggcttgacgtggttggaataccgagttctgctggtaagtgataaaccatttccatttttgtatttcgggtgcggactgccccaaatttactcaacattcgggatacttttgattgattgatatgctcaaatcccatttcttgcagagcagtgacaatttcgctttgtgaaccaaatttttcttctcgtaataatgatttaaaagcttcgttgagagagtcgagtttttccacttgttatccttttatttttatgcaattacagccgtaaatatgcagaattgttgcctatttattcacggaaatcaatctaaactcactttttttctcgaaaatttgcggtaagtctcaaaattgtattttggtatttgaaagttactatgaatttacatacactttcgctattaaatttacataacctatgaggagaaacttatgaaagttgcagtattaggcgcagcaggcggtatcggtcaagcattagctttattattaaagttacaacttccagctggcacaaacctcgcactttatgatattgcccctgttaccccaggtgttgcagttgatgtgagccatattccaacggctgtaaaagtagttggctatgcaggcgaagatccaacaccagctttagaaggtgcaaatttagttttaatttctgcaggtgtggcacgtaaacctggtatggatcgttctgatctgttcaatatcaatgcaggtattgtgcgtaacttaattgaaaaagtcgcaacggtttgtccgacggcttgtgtgggaattattactaacccagtaaataccacagtagctattgctgcagaagttttgaaaaaagctggcgtttacgataaacgtaaattattcggtgtgacatcactcgatgtattacgttcagaaacctttgtggctgaattaaaaggcaaagatgtcaatgatgtaaaagtacctgttattggtggtcactcaggcgtaaccatcctaccactactttctcaagcatttgaagaagataaaattgactttactgcagaagaagttgcagcattaaccaaacgtattcaaaatgctggtacggaagtggtggaagctaaagcaggtggcggatcagcgactttatctatggctcaagcggctgctcgctttgctcgttctgtgttaaaaggcttaacgggtgagcaggttgttgaatacgcttatgtcgaaggcaatggtgagtatgctcgtttcttcgcacaaccagtttgtttaggcttaaatggtgtagaagagttgttacctatcggtactttaagtgcttatgaggaagaggctgttcaagcgatgatcccaaccttaaaagcagatattgagttaggcgaaaaatttgtaaacggttagtcttgaatttatcgtaaaatcacgccatgatacaagggctggaaacttcaattttcagcctttttatatactactatggtgtactaatatggattatcttattaacgtcaataacactaattttagtgaagttattaaagctgcagcagaagtccctgtcgtttttcattttatttctccccgtgagcctcgttcacttgaggtggaggcttgttttcgtcgtttaaacgatgaatattcaaaacaatttctccttgctatcgtcaactgtgatgaatacccgatgattgccgcacaatttcgcatacaagcgctgcctacaagttatttctttgcaaatgggcaacctgttgatgtgattgagggtgagataaatgaacaagaattgcgagttcgtctaagcaacattttacccaaagaggaagaacttcaattcgctcaggcacttgaatttctagaagcagaacagtatgaacttgcgttaccgttattaaaaaatgcttgggaactgacgcataagaaaaacagtgattttgcgttactctatgcggaaacctatattacaatgaagcaagttgaaccagctaaagcaatcttgatgcaaattccaattcaagatagagatagccgttggcaaggtttgcaagatcaaattctattactagaacaagcggctaattccccagaaattcaacaactccaagctgattatactaagactaaaagtcctgagattgccgtaaaattggcaaatcagttacatcaagttggtaggaatgaagaagctctagaattattatatgattggttgaaacatgacctttcagcaggtaatggagaaattaaaaagcaatttctcgctattttatctgcaatggggaatgtcgctcctcttgttcctaaatatcgcagacaactttactctttattgtattagttttagtaagtgatttttcatatatttaggagaacaaaatggcaacaaaacacgcaaaattattgattttaggttctggccctgctggttacacagcggcagtttatgcggctcgtgcaaatttaaacccagtattagtaacgggaatgcaacagggcggacagctcactacaactacagagattgaaaactggcctggggaatttggcgatattacaggttcagagttgatgaacaaaatgcaaaagcacgctgagaagttcaacactgaaattatttttgaccatatcaacagcgtcgatctttcacaacgcccattcaccttaaaaggcgactttaatacctttacctgtgatgcgttaattatcgctacaggtgcatcagcgaaatacttaggcttgccttctgaagaggcttataaaggtcgaggcgtttcggcttgtgcaacctgtgatggtttcttttatcgtaataagccagtagcagtaattggcggcggaaatacggctgtggaagaagcgttatatctttcaaatgtagcctctgtggtacatctagtccatcgccgagatacttttcgcagtgaaaagattttaattgaccgcttgatgaaaaaagtcgaagaaggcaaggtgattttgcacacccacagtgttttagatgaagtgttaggcgataatatgggcgtaactggagtgcgtttaaaatgtactcaaacaggtaatgaagaacagattacgcttgacggcgtatttgtcgcgatcgggcattcaccaaatacggaaatttttaaagatcaactagagcttaacaatggttatattgtggttaagtcaggtttagatggcaatgcaaccgcaacaagcgttgcaggtgtattcgccgctggtgatgtgatggatcataactaccgccaagcgattacttcagctggaacaggctgtatggcagcgcttgatgcggagcattttttggaatattgctcataacttttgatatagtagacaaaatagttgctaatgtttgttttctttaaatattagcaaccttgtctattacatctagatcgtttgttcccagtattttcctcattgtagggagcaatatttcagtcacaattatttgttgtgctcaattttattaagataagaatatgtgttaagaggcagaaaagtaaagtgggtagaatccttcagttgattatttctgatatttattccacaaatcagcatacttcacaaaagtagaatgtgccgacagaacggcaagtaaaaaaccttgcttaccatcaagaaaacctgcttttaaaatatacatttttacaaaacagccgacagcgtgggtaacaccttggaataaagttgcttttttgccagctttggctctttgctctgaccaagccttagcgtaacttgctgattttactagataatggtgaatatctttataagtaaaatgcaataaatcgcctttaagtttagcgactttggcttcttttggataatggactttttcgtgaacaagttcatcgccgtattgagcaaaatccgtacggtaaagtctcactacataatcaggataccaccctgaatggcgaatttgtttgccaaaaacttcacttaaacgggggatttgataaaccgtatttttttcatcggaactaaccgcttgttgtatgctctgttttaattctggggtgacacgttcgtcggcatccagccagaggacgtaatcgctggtgacatattgttgagcgagttggcgttgtttaccaaaaccttgccaatcggtattttcatagaattttgctccgtattgtaaggcgatttctttggtattgtcgctacttccagagtctagaatgatgatttcatccacccaacctttgacagtttctaaacattgggcaagatcttgcgattcgtttttgacgatcattgcgacgctaagcgttggcataggttatcctttttgaaattaagtcagtttcgcctattttagcatatctttagctttaaaatttattctgaatatgctattttctacgccgatttttttagcatagaaaggcaattttaatgtcagtaaatttaacaacaaaacagaaacaatttttaaaggggcttgcccatcatttaagtccagtcgtgatgcttggtggtaatggtttaaccgaaggggtgttagccgagatcgaaaatgcgttagatcaccacgagttaattaaagtgaagatcgcaggggctgatcgtgagatgaagcagttgattattgatgcgattgtacgtgaaaccaaagcggtggaagtgcagaccattgggcatattttagtgctttaccgtcaaagtgaagagaagaaaatcagcttgccaaagatagctaggagcatttaatcaaatcttcaggaatagatgtttgtaagcacagtgatatattcatagggacagagaaattagttaatacttagaatgttgtatgaataatgaacaaaatataagcctgttactcaaacaaaattttgcatcaggattagtcgtttttcttgtcgcattgcctttgtgcttaggtattgcccttgcatcaggagtgccacctttagcggggattttatctgaggttattggatgtgtcatcgttggcgcattaagttcttctcatattagtgtttctggacctgcagcggggttagcagcgatgacagaattggggtctttcgagttatttttatgttctggtgtgattgtgggcgcactgcaattgcttctgggttttcttcgagctgggagtatctcaaactatatacctatttctgtgattgaaggaatgctggcagggatcggtgtgattattatccttaaacagttaccttatgcccttggtagtgatgatacattaattgaaattgttcattctactggacgggttcatttagggtctttggttgttgcagtagttgcgtttattattatgattggttgggaagagtaacctcgattacgttaactcaaattactcccttctgctttagttgccgttattgtggggattttacttaaccagcttttcatatggttcaacagcccgcttgcaattccaacaaatcaattagttcaactaccagtattaagctctttagatgaagtaagttccttaattcgctttcctagcttagagggtttcaacaatagcatagtctggattacagggggggactattgcagtagttgcctctgtggaaacattactttcaattgaggctgcagatcgtttagatgttcgccgtcgaattacggataataatcatgagttacgagtacaaggttttgctaatatattaacctcttcgataggaggtttacctcggtcattgtgcgttcttctgctaatacaaatgcaggagcgactcataaatcatctgcggtatttcatggtgttttgttgcttatgtgtattaactattccaagtgtgctcaaccagattccccttgcaacgctagcggcagtattaatattgattggatataaattgacacatccaaagcattataaacctttttggtgtaaggggagttatcaatttattcctttcgttgcaacaatggtttctgttgtttttcttgatttgctgaaaggggtagggattggcttagtgattagtattctatttattctgcatggaaatatgaaaagagcttattacttgagccgtgaagaattagctgatgcggataagattatacttgagctaggtgaagaagtctcttttttgaacaaggcaacgattaagaaaactttaaaaaatattcaacctaattcaaaagttacaattaatgctaagcgggctttatatattgcaagtgatgtattggaattacttgaggactttaccaatgtatatgctcaagaaaataatattcaggttaaattgcgtggttttaaatatgactatgaacatcaggaagggagagtgcatacacatattcgagttgagcatcgaagccggatttagccataaaggagtgctagaggaaatatagaccttagttcttattttgaacaagcgatcattttttcaaattttttgcaaaaaagtacttgcgttggttttgaatttctctataatgcacaccacacaacgacgcactgttgtgaagtagttaaatttgacagtgcgtcgttcttttttgctctttaacaacttatcagacaatctgtgtgggcacttgttgattgactttgtttaaaaatatttttttaattttgaagtcttgataagtgcttaacttgaaattcatattaatgtgatttttttatagtcagtacatattgagcgattaaactttttaaattgaagagtttgatcatggctcagattgaacgctggcggcaggcttaacacatgcaagtcgaacggtagcaggaaggaagcttgctttctttgctgacgagtggcggacgggtgagtaatgcttggggatctggcttatggagggggataacgatgggaaactgtcgctaataccgcgtaatgtctaaggactagagggtgggactttcgggccacctgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaagggtgatgttttaatagagcattacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggtggctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagctttcagagatgagagtgtgccttcgggaacttagagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggtgcatacagagggcgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaactgaaagggggcgtttaccacggtatgattcatgactggggtgaagtcgtaacaaggtaaccgtaggggaacctgcggttggatcacctccttacctgaatgaagagatttgcaagtgttcacacagattgtttggtaattgtagacaaggaatagagcaagaaaacagacacaagcggtcagatttgcgataaaatttgcaaattgacaggatgaaggaaagcatctttaaatgttgtccccatcgtctagaggcctaggacatcgccctttcacggcggtaaccggggttcgaatccccgtggggacgccatttaaagatgattttttgtcgaaagataagtgattatcgaatgttctttaaaaatttggaaacaagctgaaaactgagagattttctgtaggggcaaatcacatttgccctgaaacaagaaagtctgagtagtaagaaaaatcttgactgaacaaaagcagtcaagtgtttagtagttaatatcaacttcaagtgaaaatgtttgaggttgtatggttaagtgactaagcgtacacggtggatgcctaggcaatcagaggcgaagaaggacgtgctaatctgcgaaaagcttggatgagttgataagaagcgtttaatccaagatatccgaatggggaaacccagtagatgaagaatctactatcaatagatgaatacatagtctgttgaggcaaaccgggagaactgaaacatctaagtaccccgaggaaaagaaatcaaccgagattttgtcagtagcggcgagcgaaagcgaaagagccagcaagtgatagcagcaaagacagaagaattggctgggaagccaagcgacacagggtgatagccccgtattttaagtttttgttgtggtactaaacttgcaacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcccgaaagggtgactgcgtaccttttgtataatgggtcagcgacttatattttgtagcgaggttaactgaataagggagccgaagggaaaccgagtcttaactgggcggctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttatgtgaataccttcgggggtagagcactgtttcggctaggggtccatcccggattaccaacccgatgcaaactgcgaataccgaagagtaatgcataggagacacacagtgggtgctaacgtccatcgtggagagggaaacaacccagaccgccagctaaggtcccaaagtctatattaagtgggaaacgaagtgggaaggcttagacagctaggatgttggcttagaagcagccaccatttaaagaaagcgtaatagctcactagtcgagtcggcctgcgcggaagatgtaacggggctaaaatatagcaccgaagctgcggcatcaggcgtatcacaaatacgccttacgattaacaacatcgaatgaagtgaaacggaataagatgttggtcaagcacccaacacgttgagttggcataaagtgcggatagaaatcagaggaatatttgtgatacgtctgttgggtaggggagcgttgtgtaagtcgatgaaggtgtattgagaagtatgctggagatatcacaagtgcgaatgctgacataagtaacgataaaacgagtgaaaaactcgttcgccggaagaccaagggttcctgtccaacgttaatcggggcagggtgagtcggcccctaaggcgaggctgaaaagcgtagtcgatgggaaacgggttaatattcccgtacttggtaaagctgcgatgtggggacggagaaggttaggttagcagactgttggatgtctgtttaagttggtaggtggggagtttaggcaaatccggacttccataacactgagagatgatgacgagtttctacggaaatgaagtaactgataccacgcttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgctggcgtaggttgtaagagtatacctccgaaggctgaaccagtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagactaagaagcaggcacgccagtgcttgtggagtcgtccttgaaataccaccctttaacgtttgatgttctaacgaagattacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgtaccagttgtctcgccagaggcattgctgggtagctaaatgcggaagagataagtgctgaaagcatctaagcacgaaactcgccttaagatgagttctccctagctataagctagtaagggttgttgaagactacgacgtagataggtctggtgtgtaagcggtgtgagccgttgagctaacagatactaattgcccgagaggcttaactatacaacctcaagcgtttttgaagtagacgtgagagagttagagagctgaataaaagcaacaaactaactaaacaaaataaaacaaagagactcagaacagcttgtttcgaaattagaatagtgtaggggcaaattacatttgcccttaaagaacagaaaaaagaagatagagagaatcatcaaaagattttcccgacgacaatagtgcagttgtcccacctgattccataccgaactcagaagtgaaaagctgtaacgtcgatggtagtgtggggattccccatgtgagagtagagcatcgtcggggttttattaaagagaaaaaccgcaggttagagatagcttgcggttttttgttttctgtatacatatctgatttgattctccgcttttactttttttccaaaaaatgttaaattgatcacatttttaatccattgagataaccactgatgaaagagctgatcttacctaaaataagtcaaaacctagcaagctcatctctttttcaagatcaattatcttatataaaacatcgagttgatatgctcgatcagttccgtatccataatacgttacgcaaccattccgaagctttccaaagcgttttttcattattacccgctttattacactataacattccgagtttgcctgcgtatgttgaaaatgcaccaaaaggtatttttaatttcaacttatcggctactcagaaagcccatttgtcgacctattttcctctgcctgaagatacaaaatatgtcgcttttgatggtttgtatgtgatggggagtattggatcaattacgcaaacttgtttatcagacttggatctatggctttgccattcgcaatcttttagttcagaagaatctgaattgctacagaagaaattgagtttaattcggcagtgggcaaaacagcaggggattgatgtcaatttttatttgatgaatccaaataggtttaaagcaaaaaactacaatagcgatgtgtgtgacgagcataatggctctgcacagcatttcttcttgcttgatgagttttatcgttcggcaattcgtttggcgggtaaacggattttatggctacatatgaataatggcgaacaggattatgagcaatatgttcagaaagcggtgagtttagggcaattaaatccagcggaatggatagactttggcgatttctctgcattagcgattgatgaatatttcggggcaagtctttggcaactttataaagggattgaaagtccttataagtctgcgattaaaattttattgttggaaagctatgcagaaacttaccctgaaacacaccttatttctaagaaattcaagcagttattgctttcaacagcagaagttagctatcattttgatccgtatttggctatgttagagcaagtaacaacatatttagaaaatcgtaaagagtttgttcgattagaccgcttgcgtagctgtttttatatcaaggcttatgatggtcagcacgatagctggcgtaaagaagcattgagagagttggtgacgcagtggcaatggagtgaacgtgaaatccaatgtttaaataattgccgtcagtggaaagtaaaaaaagcaatgacgcatcagcagatgattgttgaacagttattgcaaagttaccgtaatttaattcaatttgctcgcaaatttcatattgatcccagcattttgccacaggataccgacattttaatgcgtaaactctattccgcatttgaagtcgtaccaggtaaagtgcctttaatcaatcaaaatatcgctcgaaatttggctgaagatgaagtgactttcattgaagtcaatgaaggtgtttcaactaaagcaggctggtatctgatcaatcacgccccgttaagttcctatgactcaacaacccgtcacgttcagtatcaacgaacacttatcaaatcagtggcttgggcttattttaatcgagttattacagcctctacgcaaattcacttggtcagccaaagcctccagctttcaaccttacgtcaatttattacagatttacgcctttcatttcctgtcgcaacgccagcattgaaagatgatgatctttatcacccaaatgaaattcgtaacctgattgtcgcgattaatttaattcaagatcccacaaaagctctcccttccttgtctaaaatggagatggcacaactggatctgtttaatttaggctcttcagagcaaggaatgattggtagtgttagcattatttatcgcaatatgtggaatgaaataatgacacagcactttgagggaaatgatgccattttgaaatccctcaagttaatttctaataaaatttatcgtaattctgcacctccacaatctgtcaatgtattttgttatagctgtcagctaagaaatgagttacaaaatgcagtaatgagtttggtcaatcgttgcattaccgtacaaacaggctctattttccaacgccagcaggcacagacattcaaaatggctggaaaaaaatggcaactgatttttaataaaaataataatttacaaaatattgttgccgatgaactcaacgatttgggtgatgagttgtcagagtttacaggcaatattcctaaagagatttatgattttgccagcgaaggctttttacaatttttctttgatgataacgccgacggtagttttaatgtttatgtccttgataaaaataaccagaccgaatgttattgcaactgtgttggggataaagaaaataaaatccgacgtattagccgatcttattcagacacggaaggtaccaaagaaagccttaatagctttaattttcctcagttttatcagctattaaaacaaaatgatatgattaaaattgtaccatttcagagtaaacaacatcgagaatttttagaacaacattaaaaataggaaagtttgtgtcctcaactttagctaaccccgaattgattaaaaccgtggtgttacttgcaacaagtattaccattgttccgctttttaaacgaattggactgggcagtgtattaggttacctcgtggcaggttgcttaattggaccttcaggtgcgggactattccaagatccaaatgcagttgtacatatggctgagcttggggtagtgatgttcttgtttattatcggcttggaaatgcaccctgagcgtttgtggagtatgcgtaaagcgattttcggtcgaggttttttacaggtcgctctatgtgggacattgctcacttttgcaggtatttttattctaggtttaccaaaagaagttgcgttcattgcaggaatgggctttacactctcttcgactgcgattgtaatgcaagtgcttgaagaaaaagggattagtaccacacctaaaggacagcgtatcgtttcgacattaatttttgaagatctagctattgtgccactattagcctctattgcatttttagcacctgaacaagctggagcagagcaagggacaaattggactgcgattggtgcgggcttagtgggagtgctgatcttagttgcttcaggtaaatggttaatgaacccactgtttaagatgatttctaaagctcacattcgcgaaatgatgaccgcagcggcattattagtggtattaggttctgctttgttaatggaattgagtggtttatctatggcaatgggggcattcgttgcaggggttatgttgtctgaatcgtcgttccgtcatcagctagaggcagatattgaaccatttaggggtttattacttggtctattctttatgggcgtgggaatgtccctcgatctttctctcgtactaaataattggttatggttactgggtgtgatattactttatgtggtaggcaaagggttatctatttatgttgttgcattagtcacaaaattaactaaccttgaagctattatgcgtacagcgattatgtcgcacggcggtgagtttgcgtttgtccttttttctgctgccgctaccgcaggtgtttttacagcagataatcaagcgactttcacagcagcagtgattgtatcaatgcttttatctccattggtgatgatcgtcattcaacgtttagtgaatttgaaagtgaaaaaatccacaggagaagctcagccaaatttagagggcattgaatttgcagaaaatttagaaagtagtgttcttgttattggctttggacgttttagccaaatcatctgtcaagtattgttagctcgcagaattaatgtttcggtgattgattctgatgttgagaatatccgtatggcaacccgtttcggctttaaggtttactatggtgatggagcaagaattgacgtattaagagccagtggtatagcacaagcagactgtgtgattgttggtttagctgaacctgatcgcactttgcaaatattagaattaattaaacacgaatatccattagtgcctgtttttgctcgttcttacgaccgattcaatactgtgaatttaattaaacatcatgttgattaccaagtgcgtgaaaccttcgaatctgctttattgctgagcaaggtgacccttgaacgattaggtgcaacagaaacagaagctcaagatgtaattaatcttgttcgccatttagatcaggagcgtttgaacgaagaagtactacacggtttttccgatgaaattgcgaaaaaatattggcgagttgaacccttcgtaaaaccagcacacgaagcgacagctttaaatgaagaaactgcagatattttagaagaaattggcgaaagtattgaggtggttgaagttgaacttgatgatcagagtgaaatggaaaagattaagttcgcgactgatgaaaagaaagaagatgaattaagttaaaacaatttttagctatttgaaagttaaattactttataatttaactttaatatgaaatgtaagatagattaagacaatgattgaagctgacagaattatcagtgcctcagcaaagaaagaggacgaaaccatagatcgtgcaattcgccctaaaatgcttgccgattatgtcggacagccgtcagtgcgagagcagatggaaatttttatcaaggcggctaaattacgcaatgatgctttagatcacctgttgatctttgggccaccaggcttaggtaaaacgacactggcgaacattattgcaaacgaaatgggcgtgaatatccgcacgacatcagggccagtgctggaaaaagcaggggatcttgccgcaatgctgacaaacctagaaccctacgatgtgctttttattgacgaaattcaccgcttgtcgccagccattgaggaagtgttgtatccagcaatggaagattatcagcttgatattatgattggtgaaggccctgccgcacgttctattaaactcgatctccccccatttacgctcgttggggcaacaacgagagcgggctctttaacttcgcctttgcgtgatcgttttggtattgtgcaacgccttgagttttattccgttgaagatctcacctccattgttagccgtagtgccagctgtttaaacttaaatcttgccactaatgccgcttatgaaattgcacgccgttcacgcggaacgcctcgaattgcaaaccgattgttacgtcgagtacgagattttgcagacgtacgaaacaacggcattatttcctcggacattgcaaaacaagccttaacgatgttagatgtcgattccgagggttttgattttatggacagaaaattactctctgccgtcattgagcgatttgatggcggccccgttggattagataaccttgcagccgccatcggcgaagaacgggaaaccattgaagatgtgctagagccttatttaatccaacaaggctttttgcaacgtacgccaagagggcgaatagccacatcgaggacttatagtcatctggggctagtaaaatctgaatagtgtaaatcggtagaatttttaaggttctgccgattgttttttgttttattcattgattttctttactcaagtcacatttttacaaataatctctataaaagtaacttaaaaactttacaaaattgattttttaagttactaattaacaatttttaacacaactaaaagcggagatcatttatgcaaacaactttcacccgttctttattagccagtgcagttgcacttggtctttccgtttctgcatttgcagctaaagtgcctgaaggtacggtgcttgcagagaagcaagagatcattattaacaatagctcagaaccatcaagttttgacccacataaaacagaaggtgtgccagaagctcaagtttcttatcagttacttgaaggtttagtcaccaaagattctgcgggcgaaatcattcctggtgtggctgaaacctggaaaagttctgaagatttcaaaacgtggacctttaatttacgcaaaaatgcaaaatggtctaacggtgaacctgtgactgctcacgattttgagttttcgcttaaacgtttaggcgatccaaaaaccgcttccccttattctagttatttaaactatcttcaagttgaaaatgcccaagacatcattgatggtaaaaaagcaccgagtgagttaggggttaaagctgttgatgattacactttagagatcaaattaagcaatccagtgccttatttagtcggtatgatgacgcaccaaacgatgttacctgtgccaaaagcggtcgttgagaagttaggtgatgcttgggtgaaaaaagagaactatgtgggtaacggcgcttataaattagtagaacacgttattaatgaaaaaatcgtgtttgaacgtaacccattgtattggaatgataaagaaaccgtgattaataaagcgacattcttagccattccaaatgcaagtaccgatgttcaacgttatcgtgctggcgatttacatattacaaaccatgaattaccgccagaacagttcccgacattgaaaaaagaaattccaaatgaagtgtttgtaacccgtacgctttcaacttactactacgagccaaacaacgaaaaagcaccatttaacgatgtgcgtgtgcgtaaggcgttaaacttggcattagatcgtagtgtgattacggataaagtattagggcaagggcaaacgccaacctatgtgtttacaccgccgtacattacagaaggtcacttaattcaacaacctgagtactcaaaacaggatatggcatctcgtaaagcagaggcgattaagttgttagaagaggctggctttagcaaagcgaaccctcttaaatttacgcttttatataacactaacgagaaccataagaaaattgcgattgcagcacaatcgatcttaaaacaaaacacgggcggtttagtggatattaaacttgaaaaccaagagtggaaaactttcttagatacacgccgtgcgggtaactatgatgttgcacgtgcaggttgggcggctgactataaccaagcgtcgactttcggtaagtacttcttgtctaactcaagtaacaacaccgctcgttataagagcgcggcttatgatgctgaaatcaatgcggcataccaagcaggcaatgcggaagagcgtgcggcagcttatgcaaaagcagaagctcagttagcgaaagattatgcaatcattcctatttataactatgtaaacccacgtttagttaagccattcgtgaaaggttatgagggtaaagatccgcaagataatattttattaagaaacctttatatcattaagcagtaatttttaagcggtgcgatttttaaaaatctttgcaaattttgctaaaaatcgctccgcttgttttcttttgttgtgcggatcggagaactgagcaatgttgaaatttataataaaaaggattttagaagcgattccaacgctttttattttaatcacattttcgttttttctaatgcggttagcaccaggtagcccatttacctctgagcgtgcttatccacctgaagtgatagcaaatattgaagccaaatatcacttaaatgaacccttatataaacagtattttatctacctcgagaacttagctcagggggattttggtccttcttttaaatataaagatcaaaccgttaatgatttaattgcttctgcttttcctgtttcatttaaactggggattgttgctttttgctttgcggtaactcttggcttgctggcaggaacggtggcagccttgaagcaaaatagtaggtgggactactttataatgtcctttgcgatgacggggattattatgccgagcttcgtctttgcccctcttttagtgttaatttttgccatttatctcaaatggctacccgctggcggttggaatggcggtcagctctattatatggtgttacctgttttatcgcttaccattgcctatgtcgcagggattgcgcgtattacgcgtggttcaatgattgaagtgctacattctaattttattcgtacggcacgagctaaaggcttgccgatgagtaaaatcatttttaaacacgctttacgcccagctatgttacctgtgattagctatcttgcccctgcgtttgtggggattattacaggatcaatggtgattgaaagtgtttttggtttacctggtatcggacagcttttcgtcaatggggcattaaaccgtgactattcccttgtgttaagtttaacgattttggtcggcacattaaccattttctttaatgcggtggttgatattctttatgctgtgattgacccgaaaattcgttattcataaggagtgtgagatgttaattaataataagaaaaatcaagaacttgcagaaaaattagcggaacagaccgctgacatcgccgtggaaggtcgcagtttatggcaagatgctcgtcgtcgctttttccgtaataaagcggcggtaagtagtctgatcattctcttttttgtggtgttattcatcacttttgcaccgatgttaatgccatttagctatgaagacacggattggaatatgatgagtgcggcacctgattttgcatcagggcattattttggtactgatgcttctggtcgtgacttgttggtacgaattgcaatgggcggacgaatttcgctgatggttgggattgcaggggcattgattgctgtggtgattggcacaacctatggggcaatttcaggctatgtgggcggcaaagtcgatatggtgatgatgcgtttgctcgaaattttaggctcgttcccatttatgttctttgtgattttattggtaacattcttcggtcaaaacattctgttaattttcgtggcaatcggtatgattgcgtggttaagccttgctcgtatcgtgcgaggacaaaccctcagcttaaaaaacaaagagtttattgaagcggcgattgtctgcggtgtgccgaaacgccagatcatctggaaacacattattccgaatgtattaggtatcgtggtggtttacgcttcccttgaagtgcctgctttaattctatttgagtcctttttaagtttcttaggtttaggtacacaagagccgatgagcagttggggggctttattaagtgatggcgccgctcaaatggaaacatcaccgtggttattggcattcccagcctttttcctctgtttaaccttgttctgttttaactttattggcgatggtttgcgtgatgccctcgatccgaaagacaaataggaagttgcacaatgaaattattagaagtcaataatttagatgtctatcttaaaaccgatcaagaattggtacacgcagtgcgttcggtttctttcagtgtggaaaaaggacaaactttagcgattgtcggcgagtcaggatcagggaaatcggtcacttcaatgtcgataatgcaattgttgccacataacattgttacctatggcgaaaattcttcgattatttttgaagggcaagatattttacgtttctcagataagcagatgcaatcattgcgaggtgatcgtatcggtatgattttccaagagccgatgacatctcttaacccatttatgcgaattggggaacaggttgccgaagcggtgagtacccataatccattgctgagcaaacagcaggctcacgaaaaagcattggcgatgttacagaaagtaaaaatcccagatgctgagaaaaaaatggtctgctatcctcacgagttttcaggcggacagttgcaacgcataatgattgcaatggcaattatcaatgaaccagatttattgattgcagacgaaccaacaaccgcccttgatgtcactacgcaagcggaaattttagacttaatgcacgatctacaagcggatatgggaatggcgatcattctgatttcccacgatcttcgtttagtgcataaatacagtgacgatgtatgtgtaatgcaaaatggcgaaatcattgagcgagggaacaccgaagaagtttttaaaaaccctctgcacccttacaccattgagctacttacgccgataccaagcgatctaaaacatcaagtggcggaaaatgcctcaacgctcattactgcagaaaatgtggatatagattacattttaaaacgcaatctatttggcaaaccgaccaaagtatttaatgccgtgaaaaatatttcactcgatctgaaagtaggagaaaccttagggatcgtgggcgagtcgggatcaggcaaatcgacacttgggcgagcgattatgcagatcttaacctatcgaggaaaaattgcctttgcagatcaagagatcgcaacgctatccaacgaacagcgtcaagccttgaagaaagatatgcaaatggtattccaagatccgtttaactcactctctccacgcttgacggtgggggagatcatcggcgagggcttgtctgtgcattacccacaaatgagcaaagaagagcgtcgccaaaaagtgatgaaaaccttggaagaagttaatctttcgccatcaatgatcaaccgttatccccacgagttttcaggcggacaacgccaacggattgcgattgccagagcgattattcttgagccgaaattcgtcttacttgatgagccgacttcagcccttgaccgttcaacacaattgacggtggtggaattgctgaataatctccaacgtaaatatggcttaagttacatctttatcagccacgatttagcagtggtaagagcattgagtaacagagtgattgtgatgagcaaaggggaagtggtcgagcagggcgaagccaaacagatcttcgagcaaccaaaagatgaatacaccaagcggttaattgaagcgtcgaatttgtaaattagcaaggcatagtagaacaggggaatttatctttttctactatgccccaagttttaggcaactgtattaacaaatgccattcttaatattctcaagctcttcccaacgctcaaacgcttgctctaacgccatttccgtatccgctaatttttgtaactgagcttgagtatagctcggatctttagcaaagaaatccgcactattcacttcggcttgtaaggcttcaatttctgcttcaagctgttccattttttcaggcagggcttctaactctcgttgttctttataagaaagtttgaccttctttccctccccctgcttgcggggggaggtgtccgcaggacggaggggagcattctcgctttctacaagcggtgctttctcaacgttttttgcaaattcccattgccctctccctgcttgcggggggaggtgtccgaaggacggaggggggcttttgaggcaaaataattcgcctgttgttgcttcgcatcgtggtagccaccgatatatttattcacaaccccttcgccttcaaagatgtagcattccgttgcagtattgtcgataaattgacgatcgtggctgacaataatcaaagtgccttgataatccgccaacatctcttccagtagctctaaggtttctacatcaagatcgttggtgggttcgtccaaaatcagtaagttatttggtttcaacaataatttagctaataacaagcggttacgctcaccgcccgataacgctttgactggggtcatcgctcgtttcggtggaaataagaaatcttgcaaatagccaagaacgtgacgttttaccccattgacttcaatatcttgcttgccgtccgctacgttgtccatcaccgtcttttcaggatcaagctctgctcggtattgatcgaaataggcaacttctagcttggttccgcaacgtactgttcctgctgtcggttgaatttcgccaagcaataacttaatcaacgtcgttttaccgatcccgtttgcaccgataaaggcaattttatcgccacgcaaaatcgtagtgctgaagtttttcagcaaggttttgcctgccacttcgtagctggcattttccacttcaaatacaattttgcctgaacgagcggtctgatcgagctgaatttttaccgtgccttgtacttctcggcgtgctttacgctcttctcgcaaggctttcaaggctctcacacgtccttcattacgagtgcgacgagctttaatcccttggcggatccaaacttcttcttgggctaattttttatcaaacagctcattttgtaaggcttctacacgcaagtcttcggctttagtttcaaggtaaacatcgtaattacttggataggaaactagtttgccccgatctaaatcgacaatgcgagttgccattttacgaataaaagcacggtcgtgagagatgaaaataatactgcctttaaactctaacaacagattttctaaccaagcaatcgtatccacatctaaatggttggtcggttcgtccaacagcaacacatcaggatccgccaccaatgcacgtgccaacgctgcacggcgaacccaaccgcccgacagctcgcacaaccgtttttcaggatcaagttctaatagcttcaaggtatcttgaatacggttttcaaactgccaaccgttcgcgtgttccagttgagcttgaacttgcgaaagttgcgacattagcgtatcgctgtaatctgtcagcatttgttgcgaaatgtggtgatattgctttaaaagatcggctaaatgcgcgatcccttctgcgacataatcaaaaacagtatcttcaatatgtcggggcggatcttgttctaaacgggtgacaacaatatctttttcaaaaatcagcttgccatcgtctagctgaacttcgccagccagcaccttcattaaggtcgatttgcctgccccgtttcgtccgacaagacagacacgttcgccctgttcaatgtgtaattcagtgtgatcaagtagtggatgatcgccaaagcctaaataggcgttagaaaggttaattaaagccatagaatatctgttgaaataaaaatttcgcaaattttagcagttttcctaccgcttgtaagtgatttaataaagtgaagtaatgaaagtataaaagtggtttgagattgtattaaacttagtgagattgtactgatttgggaggtaatggaaagagaagctattactgcccataggtaatactgttctttttgtgtatgaagtttattacaaagtttgctacaatccattcccatcatagacacggaggcaaaatgcaagttgttacaaagctcatacctaccaaactgatttccagtaaatctacgcacaacgcacgttcagcaaatcaaaacattgaacgtagtgagcttttaaaaaaacttgccgatgttccgcactatcctttaaccgttgttattgcccctgctggctatggcaaaacgacattaatttcccaatggaaagaacgcttattagcgaaaaatgaacaagtcgcttggtttgctttagatgaaagtgataataacgccgaacagttttgtcactacttttcatcagcattaaccaaagccacaggcatttcattgcaagggatcacctataaaaataacttggtggattactttgggcaactcttaatcttacttgataatgttccccgtcgattttatctcattattgatgattaccatcttattgataatcccgaaatccacgatgcactgcgtttttggttgaaacatcagcctgatacgatgagccttgtgctactttctcgccttacaccgccattaagcattactaacttgcgtattcacgaaaaactgcttgaaattgatgtacatcagcttgcctttacacctgcagaaacccgtcaattttttgaacaaaagctaaatgaaacattaagtgacgaagtgatttttgcgttatgtgagcgtgtggaaggttgggcaacggcgttgcaactgatgatctttgccattaaacaaaatgcagaactgttgcatttccctgaaaaattactgaccaagctcaatcaacaacatatcgctgactatcttaatgaagaagtttttcattatgtcgatcctgaaatcaaacgctttatgcaacgttgtgcgattttacgttcaatgaatgaaaagctggtcgtggcacttactcaagatgaaagcggggtcaagcggttagatgaactggaaaaattgggattattcatcacacgaatgacccacgatgatgaagaaatctggtggaaatttcacccgattttagccgcctatctctcgcaaagttgtcgcttagaattaccgaacgaatggcaacagctacaccaaactgccgcaatgatgtggctaaaactgggctatggctctgaagctctctaccacgctcaaatgctagacgatccacaaacgctctaccaaatactgcaagaacacggctgggcgttattccatcaagggcaactaaaattattggaagactgcttaagccacttgccatcagaacagatatggcaaaatgaaaatcttgttctgcttaaagcgtggttagcccaaagtcagcaccgccatcaagaagtgagcggtatcttgcaaaaattccagccaaagttaccgcttaccgaaagtttgcaagggcgttttgatgcattaaaagctcaagtggcaatcaatgcgggcgacgaagagcaagcctatttaattgcaaatcaagccttagccaatttgtctgatgaatttgactatgcccaaattgttgctaagtcggtgattggcgaagctcagcattgtcgtggttatctcaaagaaagtttagccttaatgcaacaagtcgaaaaaatggcaacgagccaacgggcgtatcaccactggctttggtctaaactacaacagtctgaaatcctgtctgcacaaggtttttggcaatctgcctatgatttattaaaagaaactaccttacaaaccaaagaatttcatcaaattccgatgaatgaatttttgctacgtttaaaagggcaaattctatgggaatggcaccatcttgaccaagccgaagcaatggcgaatgcaggtattgaagtgttagaaaaggaagaagaacgtattcaaagccttgccttattagccaaaatttccctaaccaaaggggatttaaacaacgcagaacgtctaattgagcagtgccgaatgctactggctcgttgttcgccccataaagactgggtaacagcacttgatgaaatccaactgatctattggcaaatgcggaatgaaactcgctatttagaaggctggctagctcaagccaatttccctagccaagagcataaccactttacccaacgccaatggcgaaatatcgcccgttgttacctgctacaaggagattacgaacaagcattgcgtattctcaacagcttactacgtactacagcgatttttaatttagtgagcgatagccaacgtgcattaattttgcgtaatcgagtttacactttacaaggcaagcctgatttagctcaaagagatctcattcaagccctaaatttaagccaacagaccaactttatcagtgcatttgtgattgaaggcgaaataatggcacaacaaattcgccagctactgcaacttaatgtattagaagaactttctacccataaagcccaatttattttgcgtagtattaaccagcacaaccgccataaaacagcacattttgatgaagagtttgtcaaaaacttacttgctaacccacaagtaccagaaatgctcaaaatcagtccgcttactcaacgagaatggcaagtgttagggttaatttattcaggttacagcaacgaacagatctctcaagaactggttgttgcaatgactaccattaaaacccatatacgcaatctctaccagaaaatcggcgtggcaaatcgtgctgaggcgattgaatatactcgcagtttattgcgaatgatggggtatatctagataaagtagaaaatcaacaatcaatttagaatctattcttcatatatatttctttttatttaagttgttttagtgtaaagtttggatgtatatgaatgtggatattattttatacaataatattttctattaatctaattaatgtttattggtaaatcactattataattttttcaaatgtgatttgatataagagagaaatataatggctaatttgtcccctgatgaagcaattgagcttgcatatgatatttttttagaaatggcttcagataatttagagcctgcagatattttactttttaatttgcaatttgaagaacgtggagcggtggaaatggttgaaactagtgaaaattgggagcaagaaatcggtgttttaattgatccagatgcttttgctgaagtttggattggtttgataaatcagaatgatgagatggatgatatttttgcacgttttttaatttccaatgatgctgagaatagagaatatcatgtaatttggaagagttagaggatgtaattgaggggacggagccaaggtaaccattaatttattttagtctaatctttttaatccagatataataaaggcagcttttgagaagctgcctttatagtcattatttttcgatctcttgtggcaacgccaacaccgtttctacaggtttcgcttcgacattaacctctttcagatcttcttgttttaatctattcgctaattcgacatcgtgggtctgttctgcgacatacagtgccataatgcgatcttttgccacgcactctttatgctcaagcagttgcacaaagtaaggtttcgctttgtcgaaattccctgctctggtgtggatgtaacccaatactcgtgcgtaatcgtcactgtaacgttcttccgctttgctgttgcgttttaagagaactttgaatagtttatgctcttcatcaacttgtaagcgtgttagttccggatagagtaacgcaagctgttcatcttgatattttttcacggtttcaagggcaatttcttgagcagactgatgatcgtctgtgtcaattaagcgtttaatcaagccaacacgaacgtaaatagaacgacggcggcggcttggttggttatcccaccattttaataagccctcttgaccttcttcattcataatttcatctaataagccgtcattgacttgctgttcaagtctttcgtactcttctgccgataagaaactacgttgtccgatttgttctaatacatcatcaagtgctttgtaagccttcgatttttggtagatttcaatcgctaggcgtaaggcttcaacgttgtttggtgcaagctctaataagctatcgactgcactgcgtgccgcagggagtttgccttgtagcagtaaaattcgtgtgcgagcaatttcaacggcaacattgtttggccctgcgattttagcagcttcaattaaatacttgttcgcattgagttcatcgcctcgttgttgagcagcttcggcagctttgatgaagtttaacactggctcggcggcgtgttttgcattttttgcaattaatctctccgctttagagtaatccccttcggtcattttcattaagcctttgagggtttgctgttgtgcttttttacgtttgcgatctccaaaccattgataagcacctcgacttaacccaaagaaacggcggacaatccactctattgcataaaccaccgccattgccaccgcaaaaaagaccacgagcattactaggctcatttcaatcactttgcctgcggtttcaatgcgtacataaccttgatgccccgaaatataaggccctaaaattaagcctgcaaggacaattagcattaaaaagagaacgcgaaacataatctatctcctattgttgctctgtagcaggttttgcttcggttggtgtttcttgagctggtgttgcttgctcaagggatttgtcttgttccaactgaattttgctaatcggtttaggggctttattgagcagttgatctaataagcctaaactgtgcaggcgatttggtgcgtcaatgtagatagattgttcaatcatctcgtcaatttcttttaagaaggttttgacttgttcattttgcacatcaaagtaacttctcacccaagtgctaactgcttcaagcgattgtttatagagttcattttgctgacgtggaattgccaaaatcgcaatttgtaaacgcaagcggatattttctcgtaagtaaatctcttgatttggtgcaacaaaagctttctcttttgccgtcgctttatcgctgatacggataaagtgatttaagaaagagttcgcacttttttctaggttttgttgccagtcttgcactgagttactcacttcgccggtggcaacactttcttcttccaccgtgttgtcgatcatcggcatatcatcaagcaaattcgctaattgtgttaagcgttgcattaaattattttgatcaacattgtttacactagcaagttggctgaggtcttgtttaatggcttcacgaatgttaagcacacggttgtcgcccacttggcttaatacattatccgcttcaataagcaagctacgagctgtatcaatatcgttatctaacactactttgcgtaaggcattgttaagtaagaaatcagcgtcagataatagccattcactttggtctgcttttggtgtcgcccctaatttttgaatttggctttgtagggcgttgatttgctgagtataagccgtttgtgcattctctaactgtgcaattttatctaatgattgttgataatcttgagtaagtttggcaattttgactttttcttcatcaaagttagggatttcagcaactgtttgttcggggtgattttgggttgcttttgcttgtaatgcttgaatttgtgtatcaagttgagcaaatttttggttgccgaagaaataccctgttgcccccacgcctaaggcaatcaagatagccagcagagagagtgcttttccccctgatgattgttttggttgttctgattgaataggttgagcaatttccacttgtttttcctcttcttcagtttttggatcaatagcggtgacttcctctgtctcttttaccatttctggctcagagactaccgcttgttctacatcgactttcacatcttcagtcacgactggctcaaggttttctgcaacgttttctgttgcttcaaccgcttttggctttttgctctgtttcgacataatgttcacctattttagttaaaatttcccacagttgagtattgtttccagcagactatgattatccgctttcattgaaatttgaatttgttcgcttttccagcctgattttcgggcaagtgtggcgatacgtttgccaaccacaattaaacgacattggtagagccaaggcagatccgcttctgcggtctgttcgataaacgtggttaaaatctcaccgcttgtcacgacaatggtatctgttcctgctcgttttgcgaggcttatctgttcgcttaaattatccgccaacattatacggcgataacattcgaggatctgcacttcagcacctcgtgaagttgcctgttcagcaaaaaattctcgccctgtatctgcgcgtaaaatcagcacattttttccagacaactgagccatttcaggcagtgccagtagcccttcactgttttctgattgaatagggtaacgtaccgcttgttcaatttgggaagcgaaatggtttgccgaacgttgtccaacggcaaaatagagtaaatcacttcgccagtgaaatcccgtttgctttaaggtttcagttgcaaaatcaacagcattttttgacacggcaaaaacataatcccccgaatttaaacgagataaactgcttggcaacgttggcagatccgcccctgcttcaacttgaaacagcggttgatgaatggcaaaaatttgctgttctgccaacatttcaactaattgttgccctcgttgatcgggacgtgtaattaaaacattcatactattcactttgataaacggtttttaaaatgtgatcagccccttttgcaagtaacgcttctgccacttcaacacctaatttctctgcctcttttatgttgccttttgctgacgctcttacaatggttgaaccgtctaacgaaccgacgagggcatttaattcaatttcatcacctgttaatgttgcaaaaccgccgataggcacttggcaaccgccttgtaaacggctgttcattgctcgctctgcttgtacacagtaagcggtcggttggtgatttaattctgcaagataggctaacactcgctcgtcattcaaacgggtttcaatcccaactgccccttgcccacaggctggcagtgatgtttctacagggataaaggtgcggatacgttcgcttaagcctaagcggattaagcctgctgaagctaaaataatcgcatcatattcaccattatctaatttgctcaggcgagttccgacgttgcctcgtaaggatttgatctgtaaatgcggatattttgccattagctgacattgacggcgtaggcttgatgtccccacaacagcccctgctggtaaggcttcaaggtttgcatagtgattagatacaaacgcatctcttggatcttcacgctcacaaatgaccgcaagccctagcccttcaggaaaagtcatcggtacatctttcattgaatggacggcaatatctgctcggtttttgagtaaggctaactctaactctttgacaaataagccctttccaccgatttttgctaacggtgtatctaaaatgatgtcgccttttgttaccattgtaaccagctcgactgataattgtggaaaacgctgttctaatgcgtctttaacgaaatttgcctgccaaagtgctagaggactttgacgagtagcaatgcgtaaaatctctttcattcgtttacttttctttaaataaagatagccgttatcctaccactatttgccctttcttgccaaaaaaattgaacagtgatcttgacgacaataaaagaaacattaaaattcgcaacgctttaaaaaagcagttcggatgaagatagctggagagtggggaataaccctacaccgacgaggtaaaatctttcaggtgcgacagcgaggacagctattggacgaacccttggagagatccactctgcatagcagaaaatggacgccgaaggcgaaagcaatgaatgcgaaacgctcaggcaaaaggacaggggagaaaagtaaccatcatttcaagcggtgggattatatttattgcttttgtgtcaggtatccttgaaacacgcaaaaaattcatcacatcattccgcttgtcttattgcttttctttccttgtaagttatttttacgaggaattatttatgtcaattgacatcattcttagctcaataaatagtatcgtttggggaccaccactgttgttattagtttcaggtgtggggatctacttcacccttaaacttaaattactgcaatttttccacttacctagagccttttcttatatgttcaaatcagaaaaaggcgataatcaatcaggggatatttctgctttaggtgcattagccactgcacttgccgccactatcggcacaggtaatatcgtcggggtcgccaccgctatccaagctggagggccaggagcggtattttggatgtggatcattgccctgtttggtatggcaactaaatatgccgaatgtttattggcggtgaaattcagaggcaaagataaagacggctatattgctggcgggccgatgtactatatcgaaatgggtatgggacaaaaatggaaatggctggcaaaactgtttgcgatatttggggtaatggtcgctctctttggtattggcactttccctcaagtcaatggaattaccacatcattgcaagatacgttcaacattccgattagcattaccgccgttatcttaacgcttaccgttgcggcaattacgctcggcggtgtaaaacgtatctcaaaaatttcaatggtgatcgtgccttttatggcggttagctatgttggggcttccctgctgattttagtgcttcacgccgataaggtgccagacaccattgtctttatcgtaaaagccgcctttaacccagaagccgcattgggtggtgtatttggttttaccgtattacaagctattcaagctggggttgctcgtgggattttctctaacgagtcgggcttaggctctgcacctattgccgcagcggctgcacatactaaagagcctgttcgtcaagggttgatctcaatgactggcacattccttgataccattattgtctgttcaatgacaggcttagtgattgtattaactggggtatggacaggtccaacacaaggggcagttttaactaacttagccttctcagaaggtttagcaagctctatcggagcaatgattgtcaccatcagccttgtattttttgcattcaccacaattttaggctggtgttactacggcgaacgttgtttagtctatctgacaggcggacgcaccaaagggattaaattctaccgcttgatcttcattatgttgattgccgtggcaccatttatcaaactcaatacgatttggacaattgcagatattgtaaacggcttaatggcattccctaacttagtcgctttgatcggcttacgccacgttgtgattgaagaaaccagaagttattttgagagattgaagaaagggttggtggagtagttatgatagattttaaatatctataggaatttaaagtcttatgtgaaacgggctgtattaagggaatacagcccgtttattataatctaatcaattagtttacgcttttgcctgcgtgcgtttacctaaaatcaccgtcaccacaaacgcaatacttgctgaaattgccataccaacactgtacattgcaaggctttcaggtttaattgatggaatacctggtaaacctgccgcacctaatgcaatcgcttttacattgaatagtgcgataaatgcacttgatgtacccgctgcaatcattgctgcaataaatggataacggtaacgtaagttcacaccgaacattgctggctctgtgatacctaataatgctgagatacctgatggaacagccataccacgaactttcgcatctttcatcacgaatgctgcacctaaacacgccgcaccttgagcaatgttagacattgcagcgatagggaagataaatgtaccgccagtgttcgccacttctgctaataattgagtttctaccgcaataaaggtttggtgcataccagtgataacgattggtgcgtagaatgtaccgaagatcgcaccgcctacaaagcctaagctatcgtataaccaagttaaacctgcagagattaatgagcctgcttcacgacctaatgggccaatgatagtgaacgctaagaaacctgcgatgaataatgagaataacggcgtgattaagttatccaagaatgatggaacaactttacggaaagctttttctaaagttgctaatacccatgcagaaactaaagtagggataacagtaccttgataacctactttctcaatttctaaaccaagtacattccagtactggattttgccatttgcaagggttaatgcatagttccaaccgtctgctaatgcagggtgaactaataacatacccagtgcagcccctaagaatgggttaccaccgaatttacgggttgcagagaaacctaaaagaactggcaagaacacgaatggtgcatttgcgaaagtgttcattaagtccactaaatccgcaatacctgggtacatatcaacaacattcaaaccttctgcaaagaagccttttgcagtaagcattgagtgaatacccattaacaaaccgccagcgacgatagctggaatgataggtacgaaaatatccgctaaaccttttacaacgctttgtaagaaaccttgtttgtctgcagcagcactagcaacttcagatgtggtcatatcaccaatacctaatgctttggttaattcagcgtgaactttatttactatgccagaaccaaaaataatttggtattgacctgcaaccgagaactgacctttaacgccttcaatgttctcaatgccttctttatcgattaaagtttcatctttaaccaccatacgcaaacgggttgcacagtgtgctgcggcagagatgttatctttgtccccgagtttatcaatcacttgttgagcgatttgaggaaagttcatagttaccacctattttttgtgtatagaaatactaaaaattaaacagtgatattttaactaaaacggtttagctaagaaagtaaattttgctaaaacgttttagttttgtaatctagatcacatttttagcaagtttagctattatgagaataatgcgtctgatagcatatgaaggatttgttataattgaacattctcagtgttacaaattagagagaacaaatatattttttaggaaatatggaacttatttttaaaatgcttctctaatttatgcagaagttaattctattttcttatagaacaggagaaacaatgaaaaaatcattattaagttacagtttatcgttaatcttaggcttaggagcgatggcttccttgcctgtttttgcaaattctgcaacccaacctaccgctatcacaaatactcaacagcagttaggctttgaactaatcaaaacaaccattaataaaagcccaacggataaagctatctatcaaggtattcgccttgcgaatggaatggacgtgttactgatttcagatgacaaagcaaataaatcgctaatgtctgtcggcttgcctgtcggttcaatggacgacccagttaagcaacaaggtttggctcactatttagaacatatgattttgatggggtcaaaagccttccctgaaaccaacagcttagatggctttttaacgaaaaacgggggctacaataatgcctttactgcgtcagatcgtaccgtttattatcttgaagtaaataacaacgcctttgatgaagcggtggctcgccttgccgatgcttttgctcaaccgttgttatctgagacgaatgctaaaaaagaagtgaatgcggttaatgcggagatggtgcgagcaaaatccaacgatggctttttaatgcacgatgttaatcttgctaccgctaacccgaaccacccgattaccaagtttgccgttgggaataaggtcacgctatctgataaagctgatagtaagctacaagatgaattagtgaaattttatcaacaatactattccgcaaacttaatgaaagcggtgctttattctaatcaaccgattgaaaaactggcaaaacttgcagaacagaccttaggcaaggttgagaataaaaaactcacagccccgacggtggatatgccgtttttccgtgcggaagataaagcggtgatgatccattataaaccggtgaaaccaagcaagatgttggcgatttcctttgatatgcctgaagataaagctcagtttaagcataaaacaggggcgtatctcgcttatgtgttcaataataataccgatggtacgctgtctgattatttgattaaacaagggctgtctgacagcggtgttcaatcggtagcgaatcatgatgttagtcgcaaccgtggtgattttaccttttatattgaattgactgacaaaggcttagcagaacaagacaaaattatctcgttggttttccagcaaattgaagcggtcaaaaaagcaggtattcaacagagctattttgatgaattaaaagagagcttaagccaagagtttcaacatctgcagacggaaaaaagtggcaactatgtcgccgatttggtgagccaaatgatgagttatccgctcgaaaatatcatcgatcagccttatgctattgaacaaatggatacgcaagcgatcaatgcaaaacttgctgagatgacattagctaacgtgcgtattttgctcgttgatgataaagcgaaaaccgataaaaaaaccaaatattttgaagccccttatgccgtgcataaaatcagtgagcaacaaaaggcaaaatggcttgattttagccaaaatcctgagcttaaactgccagcgttgaacccgtatttcgcaacggatttcagcctaaatgaaagtgataaatctcgcttaaaaccgcaactgattgaagcagagcaaggcacgcaaatctatgcaatgccaagccattattttgctaacgaaccgaaagcgaaaatctcgttagtgctaggcattacgccaaaagtggaagatcttaaacaagccgtcagtgcagtgttgctgggctatatgggcgatttagtccaaagcaaaattgatttccaagcctctattgcaggaatgagtgcgagtgtatcaatggcagaaaatggcgttgcattacaagcggatggttacacccaaaatttagcaaaattgctgaaagataaaatggtgttattccaacaatttacgttaagtgaagataccctagctcaagcaaaacagcgttatcttgaagccttagatcgtgcagaaaaagagaatgctttacgccaagcaaatgaagtaattactcgtttctccagttatccctattttgaaatggcaaaacaacgagcaatgatccaacaggttagcttggcggatattcagcaaatgcgtgaaaaattgctgaacaaagcgacatcattacgtgttcttgcggtaggaaatctttcagataaccaagtgaaacagattgcaacagaagtcgaaacggtctttaacaatcaaaatagccagattgatttaggacgttatctcgacattaatcaaagccaacgcaagctaaatcatatcaagcagatttctcacgaagataacgccttaacaatcgcctatttcccaaaaggttatgatgagttacagggattaagccgtgcgagtttattaaaagatattctctctcgttggtactttgatgatctgcgtacagataaacagctaggttatgtggtttacgcctataacactcgtatcggcacaacatcaggcttgcaattttcggtacaaagcccgacggcttcaccaaaagagataatgcaacacaatgaacgcttctttaaagaaagtttggctaaactcaacgcaatgagtgccgaagagtttgaaaaatatcgagcaagcctacttgaagtgttacaacataagccagagtccttagatcaagaatttgctgaatttgtcaccgatttttcacgaggcaacgggcagtttgaccgtaaggcaaaagtgattgaattgattaaacagctcactaaacaagatattcttgatttctatcagcaggccattatcgaccaaacaggttttgtttttgccagccaagccgttggtaaaaatccgaaaattagccaagtcgcagaactaaaaggctttgagaaggttgagagtgtggaagcattgcagaaggggtttgagattaagcggtattagtgttttgtaagcctttaatggcacatgtttgattaagtaaaacatgtgccattgtaagataggtatagttaccaaagtgttgggaagaaggaaattttctttacaacgagcccattttaatattattacggatactactctttaattaaaaggatttatataactgtcgagtatgttctaatagcttacggcgtgaaaagaaaaattgccaacggctaccgcccatttgttgccacaaaatccctgcacggatacctgccaataacgacgctctcactcgattttgaatatcagggcgagagagataatcgtgcatacctaaaacgtgaatgcgagaacctagagggctgataatatcgctataaatactcgcaatatttgcaatcatctgttcgtgcaaaatatcgttatcatagagagcaagctggcgttcaagttgttgcaaacgttgtgctaaattcgcttttgcttggggatttttagctaacttttggcttaatgctaatatgctgatccaatagcgaccaatttctgtgtcgagcttgccattcgccccaccaaattgagccaatgcggtttctaacccttgtttcaaatgggctaaatcgcccccaaaaacatcaagtgttgagtcaggttgggtaataagtaagctagaaagagagtgtctaaatgcatcacgatccgcaaagcctttatgtgcaaattgttgaacaaggcttgcagactggcatacgccagctaatgcgatggaaatatcttgatagtgagccattttcttgaaaaaatttacaaaattagcaaggaatatagcattttttcagtaagttttgaacgcttttattttattgcattttcccccttgtatttcctaaatctacccccataatgtacaaattctattttaggagagcaatccaatggcaagaaaaaagaaacctattgaattaccattacttccactgcgtgatgtggttgtgtttccttatatggtaatgccgttatttgttgggcgagaaaaatcagtccaagccttgcgtgcggcgatgaacaccaacaaacaactgtttttagtcacacaaaaagatccaaacaaagaagatcctacggcagatgatatttatgatgtcggggtaatggcaaatattatccaaatgttaaatcttcctgacggcacggtgaaagtgctggtggaaggtcaagtgcgtggcaaaattgaacatattcgtgatgatgaaagtggcttttgggctggcgtttcctcgatgccttctgattatcaagatgataacgaagagttaaaagcgattgccaaaactgcactcaacgaatttgaaaattacgttaaaagcaataaaaaagtccctgcagaaattttgccaaaattgcaaaaaattacctttgaagaccgcttggcagatacgatatctgcgaatttgattgcttcggtaaaacaaaaacagacattgttggaagaagctaatcttattgcccgttttgaagccttgttgttagcgatggcaacggaaatggacacaatggaaaccgaaagccgtatccgtaaccgtgtaaaacagcagatggaaaaaaatcagcgtgattattatttgaatgagcaaattaaggcaattcgtaaagagctgggtggcgaagaagaagcggaacagggtgaattagataagctcaaagagaaaattgccgaagcaaaattgccaaaagaagtgcaagaaaaggtggatagcgaatttaataagctgaaagcaatgccacaaagttctgctgaagcgacagttgtgcgtagctatatcgactggattttacaaatgccgtggcataagcggtctgttgtgaagaaagatttgcaaaaagctcaagaagtattggataaagatcactacggattagagcgtgttaaagaacgtattttggaataccttgcggtacaaagccgtttgaacaagctcaaaggtccgatcctttgcttagttgggccaccgggcgtggggaaaacgtcacttggtcagtcgattgccaatgcgacaggcagaaaatatgtgcgtatggcattaggtggcgtgcgtgatgaagcggaaattcgtggtcatcgccgtacttacatcggttcaatgccggggcagttgatgatgaaaatggcaaaagttggcgtgaagaacccgcttttcttattcgatgaaatcgacaaaatggcacaagatatgcgtggcgatcctgcgtctgcactgcttgaagtacttgatcctgaacagaataaagcctttaacgatcactatttagaagttgattatgatctgtctgatgtgatgttcgtggcaacatcaaactcaatgcatattccgcctgcattgttagaccgtatggaagttattcgcctttcgggttatactgaagatgaaaaaatgcatattgcgaaagagcatttgattgcgaaacagcaagagaataacggtttaaaagcgggggaactcgtaattgatgacagtgcaattttgggcattattcgttattacacccgtgaagcaggtgtgcgtagccttgaacgtgagattgcgaaaatctgtcgtaaagcggtaaaagcgttagtgatggataagaaacttaaatcgatcaccgttagccaagaaaacttaaaagactacttgggcgtacagcgttttgactacggtaaaatggatagccagaaccgtatcggcgaagtgactggtttggcgtggacggaagtcggcggtgatttattgacgattgaaaccgcttctgtggctggtaaagggaagttctcttacacgggttctcttggtgatgtgatgaaagagtccattcaggcggcaatgatggtcgtgcgtgcaagagctgaaaaactcggtattgcgagcgatttccacgaaaaacgtgatattcacgttcacgttcctgaaggtgcaacgccgaaagatggcccaagtgcaggtattgcaatgtgtactgcattaatctctagcttaacgggcaatccagtgcgtgcagatgtggcaatgacaggtgaaattaccttgcgtggtaaagtcttgccaatcggtggcttaaaagagaaattgttagcggcacatcgtggtggtattaagacagtgattattccaaaagagaatgaaaaagacttggaagaaatccctgaaaatgcaaaacaagccttagaaattcacgctgttgaaaccattgatgaagtactggcgattgcgttgcaaaatccacctgaaggggttgaggttgtgtcaaaatctattccaccaattaaagtgaagaaaacaaagactcgtccggctatgcaataaatagttgatattagctaaggtgactatgcctcattatttagagtgtaatagacaaattttctgctaaaaatggtttaaagccttgtactatacggtattataggctttaagccgttttttagcagtcattttgtaaactatgccaaacaatttcaaaattagaaaatcgctctacgcaaaatttgaatttctactatctaaataatcttatttactaaaaacgtcaaaacttcataatgtgccgtatggggaaacatatcgaatagttggacttttttgagttcataatggctgaatgaggcaaaatcttttgccattgtttctgcattacaactagaataaatcaagtagggtgagccgagttgattgataaattcggctaacggttttccgataccccgtcttggtggattgacgatcacgagatcgggcgttgttccttgttcattcaaggcaaattgagccgagtccaatgaggcgaatttgacattttgtaagccaagttgttgggcggattttgtggcactggcgatagcagaggcagaaatctcaatgcctgtaagtgcgacgttcggattggtggcttgtaatgtgtgggcacaatgtagcccaaagccaccgacaccgcagaacagatcccatagttgagtaatcggcaatgcttttatccacgcttgagcagtgtgataaagttggctggcgaccgttggattggtttggaaaaatccttgcggacgaataaacagcggaatttggttaaaacgctcttctaatacttgctgttccgtcagaaaaatctcttgttcaccttccaaaatcgcagaatgttgcggttgtatattcaaactcaccaccgatttttcaggcagttgagccagtagcatcggcaattcacgctcaacaagcggtcgttttagctcacttcttaacacaaagcggatcatcaaagattgattatgctgactttgggtaatcaagatgtatttgagttcgccccgtttttttgccacgttgtaaggcacaagcccagcccgtccgataaaggttttcagaataggaaaaagtgacgtaaaggcttgcggatagagcggacagtccgttaaatcctcttcatttaaaatccctaaaatcgggcgttcaacgcttcctgtgatcaccattttggctttgttacgaaaatgtgccaaaggcgatgtgaccgcaggtaaaaattccgtgctttgcaaaagataaggcgaaactaaccgcttgagatcggcggttttttccgcaagctgttcggcatagcttttatgaagccattggcacgaattgcaacggttttgttcaaaatggtggcaagtgagtttaggcattctgggctttccattccaaccattgatcttgaagtgtagcaagctgttgatgagcctgttgccaacgtgggctggcttccagttctgaccaacagatcgaacggcgtttcattaggcttaagtagcgttctttctgcgttggggtaggctgatatttcaggttatctaacacttgcaccacgccgtcaggctcgttgcagagtagcaacaaatcacaaccagcttgtaaggctttctcgcttcgttccacatagttccccataaaaccagcccctttcattcctaaatcatcagagaaaatcacgccgttaaattgcaactgcttgcgtaaaatctctttcagccagtaactcgaaccgctggcaggttggctgtcacactgggtgtaaatcacgtgagctggcataattgccgataattttcctttggcgatcagctgtttaaacggttgaatatcgtgattaaagatcgtttcttttggacgatcatcaaagggcgtttcaagatgagagtcggcaataacgtgaccgtgaccagggaaatgtttacctgtggttgccataccgatttctcgcataccgtcaataaaggcttctgcgacaggtagcattgtagctacatctttcccaaacgagcgatcgccgattgccttgctacaatgccctaaatccaacacgggggcaaaacttaaatcaatatctaacgcaaacatttctgctgacattagccagcctgcctcttgagcaaattgcaagcggtctaattgtaaaaaagattgcattgcaggcaatttggtaaagccttcacggaaacgttgtactcgaccgccttcttgatcaacggtgattaacaatggctttttcactcgttggcggacagatttaataagggcttgtaattgggctttatcgtgaaaattgcgtgtaaagagaataagtcctgaaaccagtgggtgttcgagtaactcttgttcttcttgagtaagttcgtagccagcaagatcgataagtagcatgataaacctttgtaaaaattattatttttcttttaagaaagtcagtacttttgccaaatcccttgtccgctttgacggtggcagacttttcaaaaaagtcgagccgtattgtcgcatcacaagacgagagtcacagataatcactgcccccctgtccgttacatcgcggatcaaacgccccacaccttgttttaaggtaatcaccgcttcgggaatttgaatatcattaaagggatcgccaccttgcaacttacaatcttccattcgagctttcagcaatggttcatcgggtgcggtaaaaggcaatttgtcgataatcaccaacgacaacgcatcgccccgtacatcaatcccttcccagaaactttgcgttgctaccagtacactatttggctctgcaacaaacttctcaagcagacgacttttactggtttccccttgcaacagcacgctcaacgaactctgttctcgcaagaaatccgctaaaccacgcatcataaaataggacgtacaaagtaaaaaacaacgcccattattcgcttcaatcacaggtttgagcaactgccccaattctgtcagtgtatgggatttattcgtatcaggcagataacgtggcacacagagcaacgactgacgagcataatcaaacgggctttgcaacaccatctgttctgcattctcaatgcctagtcgctggcagaaatggtcgaactttccaccgacttcaagggttgccgaggtaaaaatccaaccgacttgatttgcttttatctgctcaccgaatttatcggcaactgtcagtggcgtaatgtgcaagccaaacgaacgaccattgatttcataccaataacaatagccgacaacactagtatcgcccaatctttttaactgtactttgacttctgccaaacgttcaaagattttatccaaagtttctgaacgaccgagcgattttttcaccacttcgcttaaaaaatcaatgttctcattcagcttagcaaagccttctaccacttttggatcttgcaaaatctcacgcaaattcccccgcttgttgccgtctcccaacaacaaacggaaatcctgcaccactttttgtagatgatcggacgctttacccaactgagcaagatctttcaactctgtacgataaacaatgttactgtctttacaaatatcaaataattgacgagaagtcagcgattgcccaaagtactggctggcaatatcgggcaattgatgtgcttcatcaaaaataatcagctctgcatcaggaattaactcgccaaagcccgtttctttcaccgccatatcggcacaaaataggtgatggttcaccacaaccacatcagcttccaacgccttgcgtcgagcttgtaccacatagcactctttataattcgggcaatccgatcccaaacagctttctgccgtcgaaactaattgcggtaaaatcggactatcttccgcaatggtgatacattcgctcaaatcccctgtttttgttcccgtgtgccatttccgcaccttcgccaaatccgccaacaccgatttatcgccaaccacgcctattgcgatcacctgatctaaccgctctaaacagagataattagcacgcccttttaataacgccacttttcccttatatttcaaggctttttgaatggttggcaaatcacgattaaacaactgatcctgcagatttttagaacccgtagaaatgatcgtttttttgcccgatagcaacgctggcacaagataagcaaaggttttccccgttcccgtccctgcttcaatcaccgcacttttggcaaatttcacggctcttccaaccgcttgtgccatttctaactgagcatctcgcggacgaaaaccgtgaatgttttggcttaacgtgccttcggggctaaaagcgtcggtgattttttcggatagtttcatttgaataagtaacgtaaagaatcttacatccatgtaagagatttaacgatagttgaagaatggaaaatacatcaataatctgtactcagaatattaaattaacactattttgtaccaaaaatcttatcgcctgcgtcacctaagcctgggataatatagccattttcatttaagtggctatcaatcgccgcagtataaagctcaatatcagggtgagcagcttcaagtgctttaataccttcaggggctgcaacaagtactaacactttgatttgtttacaacctgccgcttttaaaagatcaagagttgcaatcatcgagccacccgttgctaacataggatcaactacaatcgctaaacgttcgcccacatcgttagctaattttttgaaataaggcacaggctctaaggtttcttcattacgatagatccccacaacgctaattctcgcacttggaatatgctcaagtacgccgtccatcatacctaaaccagcacgaaggataggcacaacggtgacttttttacctttgatacgttcaatttcaactggaccattccaaccttcaatggtaactacttccgtttccaaatctgaggtcgcttcgtaagttaaaaggctaccaacttccgttgctaaggcacggaaatctttagtgcttacatcagcggcacgcattaaaccaattttatgtttaataagcgggtgttttacttcaacaattttcatttttggtctccggttatgtttaaaaaaaatcgggctattctatcagaatttagcaaagaaagtttaatctagatcagataaaagttcccaaaatgcccgaatgatcggttcttgcaaacggcgttgctgaacgcaaacacctaactcaaatgcatcaatcggggtttctaattgaatatgggaaatctgatttgccacagggctttgttgcaccaccacatcggggatcatcgcaacaccacagcctaaagctaccatcggcacaatcgcttcgtgtccttccaccgtagcataaattttaggctctttaattttttgcaatttaaaccaatgttctatccgcttgcgagcaggtccatcgacaggcaagataaaaggcatattctgccaatcaatcggcgttttctgtaacaattgcgttgcagtacaagcaatgcgaggagcaactaacgataattgaatatcatcaatatagtgaaaaataatgttattcggcaagttttcaggcttccctgcaagagagatatccgactgcaacgattgaacgctatacagtgctttagcaggatcgcctgtgctcaatttgatctcaatcttaggatagcgttttctaaattttgctaaaatgcgtggtaagtggctgtaagaagctgttacagagcagaaaagtttaagctcaccttccaattcagtttgctctggagagaaatggcgttgcattttctgccactccgcccaagtctgctccgcaaaatgtgaaaaacgttcaccggcttccgtcaaaatcacttgccgattatcccttaaaaacaacggctgcccaatctcttgttccatacgttgaatatggcgagaaagggtagaagcactcatatagtttttttctgcagtgcgaataaaactacgggtttgagtgatgtctaaaaaaagtttaagggattggaggtccatttatttatatttcaacatacaatgttatacaaatatacataaaaataatcattttctatgtcaaatacatatgtaatatttttcactatttaaattcaacagttcttctacgaattttttcaacaaatcttctaaattctttagctatactatttagtatattttttttctttctatactcaccaattttcttaaggcgaattgctctatcagtttcaagataacttggtaaggctgatacttcattattataaaatctttcttgaatgcacaaggcaggatttaattgaaaaacagttagttctttatttaagataaaataattaaataagagttcatcaatagcgtctaatgaatttggtggtaattgcttgattaactcaactgctttaactgcagctctcttagagattatatatccagcagctcctacatacgatctgtttaacttgaaaatctctctatctaatacagaatagcggggcgttcctttaattacttttttaggaaatgattctaattttataataaattcttttcttacatctaaatgctcaaaccagtcataattatttaaatatttattactattttcacctaagataatatcatcttcaaatatagtaaaataatcataattttcattaataccttttaataaaagcatataatggctcataaaacaggctttttctacttcagtaagcgaactttcttttaaattaggaagatagttattgatatgctcattaagtatctcagatgggtataatgcatcaaagaatgcaaaatctatattatgtattttaaattcagaaataatatgctgtcttcttttttcagaatcttttaaactaatgacataattaaccattataatttccttcaatatgaattaactctatttgttattcaagtaattattaaaacttttccataatcatagaaataaggaagaactttaaaatatagcatacttgtaaataacatatttttatgctatcttagcataaagtttattttaacggaagagttttatggtaactaattatataattagtcttatatcagctgatataagacgctcacatattaataaagagttttcgtctaagaatattaaatttgaattttttgatgcatttcaaccactaggaaaagagaatataatagaaaatatattgccacaattaaataagaacactgttctcacagttggagagaaaggttgtcttataagccatttattactatggcaaaagtgtattgatgaagatatgccttacattagtatttttgaagatgatgttatcttaagtgaagatgcggaatattttctaaatgactattcttggatttcaggttctatgattaaacaagataattttatagtacgttttgaaacatttttgatgcctgtaatcagtgaaaaagctcaaaatattgctcctattaatggtagaaatatatgtattcttaaatctaaacattatggtacggcaggatatattatttctaaaaatgcaattaattatttattaagattaattaaatccttggaagcagaagatattaagcctatagatcaaataatttttaatcaattgttatcagatcagaacttatttatatatcaattatctcctgctatttgtattcaagaactacaattgaataaagaagaaagctcattatatagtcaaattgaagaagatagagcaaaacgttttataactaagcctaaagaaaaaatgagtatattaggtaagattctaaaagaattagatagatataaaaatagagataaacgcaaaaaacagagaatagaagagatagagctagaaaatcagaaaagtattattccttttgaataacattaaacctcaagtcttttactataaggcttgaggtattctttttttgtgaccctatcccaaattctgtgtaaacacccatttcaacttaatggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaatcttcgttttaggatagactgcattgatggcttccaggaagccttttaaaccgtctacacaggcaataaaaatgtcttttaagcctcgattttgaagctctgtcagcacatttgcccagaacttcgcaccttcattttcagcaatccaatcacggtcacgaggcgtctcaatttctatctcaccttcatcacaaatgacggtcttagatgtgtaaccgttacgtgcatttttaccttttctaggctgatgttttcataaccaagatggtcggtcagttcaccatttaacgcagcctcgacggtgattttcttgagcatccgtgaaaattgattgaggtcttccggtgtttttagatttttggcaaattccgctgccaaggcgtgaagttgtttttcgttcataataaaatacctgtgtctgaatgtattatctcagaaacaggtatttacacaaattgtgggagaggctcttttttgtgtgtttttgattagtatatcccaaattttattcgatctttaaaatcattttttaatttcttgaaaatttggcgataatcattctgagctaccttatttaaccaatgttgtggtttattattaattgaattaaatagcttaataaataattgagacttagtatgattgcatttactatgccaaggcttatcttcaccacaataatggaaaatagagattgggaaatttggtctttcttgatcactcaattgctgtttttttaatattcgatatctaaggtaaggttggaaattatatttggtgttaattatcttaaccttatttttaaaaataatattcaaaatatcctgatcttgaaattcaatatatggatattcttttatacatactatggctttagtatataaatcaaaattttttaacttattaagatctattaataatactccagcgttaaagtaactattagattcatcaaagcctatttttgctttataattatccaaaccatattcaacaaatgaatcaaaacaagccgcaatatgatatttatctagatttatattccataaatcaataatgctacctgctattaataagtctatatctagataaataactttatctacattctttacataatcagctatttttaatcttgcatatgtcgttttagagatatgtgaaattgtttggggaaattcactgaaatcatcttcatttataggaataaactctatagagcctctatgattatctactatgtttataatacattctttactttcactagatatacctaaatccaatacataaaaattcatcataattttatgatggtttagaatgcttaatatatttactgcaagatagggggaatatttttcatcgcaacaaaaaacaatattcatctataactcctattatatattacttatatatttatatggtctaagcatttttttattatcttaattttttgtttaaaagtaaaacatttggcattactagtaaaaatggttctgcatatggtgtatgaatctacttttgcagacataaagcaatcgaataatatttttttaagattttctatatctttataagttagtctattccaaacatctttttccagcaagagcttattaagtacactaaatttgatattatcaaaatctattatattaacgaagcctagattttccatatagtaggtaataatctctcgtctaattttttttgcagtatttatttgtgaggcattatgatttgatgatgtttgttctgaatgtaatctataataaactagagcttcaggataatttgccatctttcctaacttacttacttcaaaccagaatttataatcttcagcatgtatataattaagatcatatattaaaccatattttttatgtattaaacttttcataatcattgtattattatgaataggattatagaataacatatcattcttaatatgagcatctgttagtgcatttttccaaatatctcctgttttatagtatttacccagctttccattgacagatatgatttctagatagcaacccattgcaataattgtaggatcttccaacattttctctaaaatgtttttaatccaatcaggtttggctacatcatcagaatctattttagcaatatattctccttttatatgttgtatccctttatttaatgaagatatatatccaatgttcatttcattatttatgatactaattctattatcttgattagctaacttttctatgatatgttttgtattatctgtagaaccatcatttacaataactatttctaaattagtatatgtttgatttattacagagtttatacactgttcaatatatttttccgtattataagcacaaattaaaactgagactaaagggagatgcataagatcctctaaatataaatttcatttttgagaagctacactatctatcgtaggcacttctctcatttgagattggattatattattaaatttcaagggaatggtaaatcccgttttcaatgatttattaattttttcaattataaaaatctctcatatttaaattcataaaattagtaaagtttttacaaaaaatcatttaccatgatcccattattttacttgtaatcttatccttatattttatagatgaaaaaatcttatattttgattattacagctcattctcttcttacaataaccctaaacacattctcaatccgctcatcaataaactcaacattaggatactcttttaatactcttaatataccacttcctagccctctataaggaagtgctctaggagcgaaagaggcgagaattgggtttcgtatattggagttgcctcgttttatattttcaattgtaagattattcggcaaatgcccagggctaataatctcaatacgatcattaaatattaaaattcggattggagcagaaataaaataatctcgatgaatgatcgcattagcaatcagttcttcaaacacaattcttggtatttcaggttctccaagagagttaaaactttgtccattttgtttgtgctgaatattggttaagataaaacttatggcttggcggaactgttccgtgatattacctcgaatgtctttactatcaatatagtgttgttccgtaatatcatttcctagaaatgaaacagcttttatgataaatgttggtaaatatctacttggatctttagtaaataataacgctccgcaaatattaaattcaccctttttcattacattcatattttcaagtaattgagctttagaaaaatgttggctagttacgggttcaccataaaacttctcaaaaaagtgatcaaaataaacttcatcaagatcttgaatagatgacccagtaacaggtaattcatctgcgtgtacaagggaagcttcacgaaacattcttaataattcttctcgagctgttattttacgtttatcggctccactttttgtccaaaaatagccctgagaatccatatacggcttgctaattccctcggaaatatggacgacgataacaattccatctggaaaggtaatattttcagtaagtggagaaattgatggatggacattttgagatgcgacattagcaataagttgattaagcctaaatacatcatcattagttagaccacttaatgtaccattatcatgtacgccaataagtaagattcctcctagcgagtttgcaaaagcaaccatctcagcggctaaagcatcagggtgagtaacattagctttaaactgtaatttgctaccttcccctttttgtatcaaagcaagtaattcagtatctaacataatcttagcgtaattttcaaacataaaaaaactacattattgtggagcttttttcgaaaaatttcaaatcattttgtgcttgaaacgttcagggttaccatcggtatcaataatacaatgaatgagttagatataactagaaaatagtctatccaattccatctctgaattatcagacaccaatatttttggagagctatattggataactccttcttttctatcggtatagttatagaaaaatctaatcatttcatcattatctttgagatcaaaagattgatgggtaatgtaatccaattcattattcaaaacatctcggataatattgaaatttttttgtttattaaaaaagtgatttactctttcattgttggcttctactaaacgatattttaattcttttttatctggattacagattaagataccaacattagcaaattcttctgtttcaatataagggcggtagcggataaaactatatagtaatccttcattcatttaaattcctcccaaaattcatcattttctattctttttaatatttgtgttatatgttttaaataatcttcaaatagtttggtatatccgatttgagtttgcccaagtattgatataatttgaagatcttgcttttgattcattattgctttcctaattatcatatcattgccagagcagcattttactggatacattctttaggcataaaaaaacctccactattgtggaggttttcccgaaaaatttcaaattattttgtgcttggaatgctgaagcgtttgttgaagcgttcaacacgaccaccagtatcaacaacacgttgtttaccagtgtagaacgggtggcatttgccacatacgtctaagtttaaatctttacccgctgttgagcgagttttgatcacgttaccgcaagaacaagttgcagtaatttctacataatttgggtgaataccttgtttcattatagaaaacctctaacgaagccatatcgccactagagcatacaactcagctgtctagtaccatatgtatgaataaaaaaactaggcagaagcctagcaccaaaaagagtgagcattctactcgaaatttttgaaaatgacaatattgaatcaagattgtagatgatacttgtacttttttgactatttttaggtaagtgtttttgcttatcaagaaaattttcattaaaatctcgccgcttatttactttatttgaaaagattatgattgattttcgtcctttttatcaacaaattgccccctcgccgttatctgcttggttggaaacacttcctttacagctcaaacaatgggaaaaacagacgcacggcgattatgccaaatgggcaaaaatgctagaccatttgcctagtttgccttgtgaaattaatttggcagataaggttgaagcccgtttggttgagccgttgtctgcaggtgaaatgcaacgcttggtacatcacctaaaacagcttatgccgtggcgaaaaggtccttaccatctgtatggtgtacatattgattgtgaatggcgttctgattttaaatgggatagggttttgccccatttatcaccgttaaaagaccgcttgattttagatgtgggctgcggcagtggctaccatatgtggcgaatggtgggcgaaggggcaaaaatggtggtggggatcgacccgacggaactctttttgtgccaatttgaagcggtgcgaaaattgttaaataacgaccgcagagccaacctaattccgttaggcattgagcaaatgcaacccttgcaagcctttgatacggtattttcgatgggggtgttgtatcaccgtaaatcgccgctagaccatcttgcccaactgaaaaatcagttagtcaaagggggagagctggtgttagaaactttggttatcgacggtgatattaatgatgtgctggtgccggcagaccgttatgccaaaatgaaaaatgtgtattttatcccgtctgtaccagcgttgattaattggcttgaaaaagttggctttaaaaatgttcgttgtgtcgatgaagccgtcaccacattagaagaacagcgtaagacagattggttagaaaatgaaacgttggttgatttcctcgaccctcaagaccattccaaaacgatagaagggtatcctgcaccgaaaagggcagtggttattgcgacgaattaaaatatcataatctctctagtatccaaagttttccccgttcttcagaacggggatttctactagcatccagtaaatctaatatgcatcttttataacccagccttcaaactcgcttcaataaacttgtctaaatcgccatctaacaccgcttgggtattgcgattttcaacacccgtacgcaaatctttgatacgcgaatcatctagcacataagaacggatttgactgccccaaccaatatcagacttactctcttccattgcttgtttttctgcgtttttcttcatcatttccatttcgtagagcttcgctttgagctgtttcattgcttgatctttattttgatgttgtgagcgtccgttttgacactgcaccacaatacctgatggcatatgggtaatacgcactgcagactccgttttattaacgtgctgaccgcctgcaccagaagcacgatacacgtcaatacgtagatcggcagggttgatttcaatgtcaaaatcatcatcaacttcaggatagacaaaggctgctgcaaaagaggtgtgacggcggttattggagtcaaacggacttttacgcactaaacggtggatccctgtttccgtacgaagccaaccgaaagcatattcgcctgacacacgaattgtcgccgattttaatcctgccacatcgccatcggatacttcgatcaactcggttttaaagcctttgctttccgcccaacgtaaatacatacgcagtagcatttctgtccagtcttgagcttctgtaccgcctgaacctgcctgtaaatccacatagcaatctgctgcatcgtgctgaccgctaaacatacgacgaaactccaacaaggctaatttttcttctagctggttagcttcttgttgtgcttcggtaaaagtttcttcatcttctgcttcaacggcaagttcaattaagccttcaacatcttcaatgccttgctcaagtgttttaatcgtattcacaatagtttcaagagcaacacgttctttgcctaacgcctgagctttttcagcattattccagacatccggctgttctaattcagcattgacttcttctaagcgttcgacctttagatcgaagtcaaagatacccccgaagtgtacgggttcgttcggctaaatcatctaattgggttctaatcggattgagttcaaacatagttattccttgtagtttttttaaagcggagcattatagcgaaatctaggaggatgacaaactaggggatttatccttgtataagaatcatgtatttacctttaccctttaaaccctagatataaaacacaaatgttgtaagctagcggccaatgtctattagccgatcaataacctttggctttcaacacattgtgcggtattattgagagataaattaaggagttttatatgcaaacacttactcaacaactattaaatgatgtccttaatattgccgttcaagcaggagaacatctcaaacgcttttatcagcgttctgtggaaattcagattaaagcagataaaacccctgtgactgaagctgatctttttattagccagtttgtgattgaacaattacagaaattgaccccaaatgtgccgatcttgtcagaagagaactgtaaaattccactttcggagcgttcgcaatggcaagaatattggatcgtcgatccacttgatgggacacagcaatttattgatagaaccgatcaattttcagttgtgattgggttggttcagcaaaatcgccctgttctgggtgtcattcattcgccgatcttagacaaaacctactatgcaatgcgtgcaagcggtgcttttgttagagaaaatggcgagatccgtcgtcttaattcgaatagccaaaataacgataaatcacaccgcttgcaagtgactattggtacgtcaagtagcgacaaaattcgccaagctgtgcttcccccttatcaagtggattttcttcaattcggttcaagtagcttaaaagctgggttggttgccgaaggtaaggcggattgctatgtgcgtttaggggatactggagaatgggatacggctgttgctgaagtgttactcgcagaaacaggcggtcaggtcttcgatcttcacttccaaccgttaagctataatcaacgtgaaacctttgtaaacccttattttataatggtggcaaataaacaacgtgattggcaacagattttttcttttaattgattttatttattgttatattttgttatgaaatctaacaatttttttacattttctaggattgcaaatgaaagcagacaataattgtattgtgatttttggtgcgtctggggatctcacctaccgcaagttaattccagccctttataatctttataaaatcggcagactttctgaacatttttctgtattaggggtcgctcgttcccctttgaccgatgaaacttttcgtcaaaaaatgcacgacaccttagtcaaacttgaaaatgcaagcggtgatgtgttagaaaaattttgcgaacacctttattatcaatcggtaaatacgtctgatgcagtggattatgcaaaattattgccacgtttagatgaactgcacgacaaatatggcacaggcggtaatacgctatattatctttctacgccacccagtttatacggcgttatccctgaatgcctttcagcacacggtttaacaacagaagaatttggctggaaacggatcattgttgagaagcctttcggctacgatattgaaacggcaaaagcccttgatattcaaattcacaagtattttgaagagcatcagatctaccgtatcgaccactatttaggcaaagaaaccgtgcaaaatttgctcgttttgcgtttttctaatggtctatttgaaccgctctggaaccgtaattttatcgattatgttgaaatcacaggggcagaatctattggtgtagaagatcgtggcggttattatgatggctcaggggcaatgcgtgatatgttccaaaaccatttattgcaagtgttagcaatggtcgcaatggagccacctgcgattattaatgccgattcaatgcgtgatgaagtagcgaaagtactacattgtctgcatccactttcaaatgatgatattaaaaataaccttgttttaggacaatataccgcaagcaccattaacggcgaagaagttaaaggctatctacaagaaaaaggtgtgcctgaagactctaacactgaaacctatatggcagtacgttgccaaattgacaactggcgttgggctggtgtgccattctatgtacgaacagggaaacgcttacctgctcgtgttacagaagtggttattcactttaaaataaccccacacccagtctttagtcaaaatgctcctgataataaattgattattcgtatccaacccgacgaaggcatttcaatgcgtttcggcttgaaaaaacctggtgctggctttgaagcgaaagaagtatcaatggatttccgctatgccgatcttgcttcgccaagtctattaacggcttatgaacgtctattattagatgcaatgaaaggcgatgcaaccctattcgctcgtaccgatgcagtacacgcctgctggaaatttgttcaaccgattttggactataaagcggaacgtgggcgtatttatgaatacgaagcaggtacttgggggccttctgaagccgataaattgatcgccaaacacggcaaagtgtggcgtaaaccaagcggtttgatgaagaaaaaagtttaaatctccccctgccccctctttttcaaagaaggggaataaatacaagatcatctattcctcataaatttccccctttgaaaaaggggggattaggggggattttaaggaaagtgaaatgaacacaattatttttaataccgctcaaaatgctgttgaaaaaatcgcacaagaatttgtgttatatagtcaattaaaccgccccgtgcatatttccttatcaggcggaagtacgccaaaactgctgtttaaaacccttgcacaagagccatataaaagccaaattcaatggcaaaacttacatttttggtggggcgatgatcgtatggttccgccacaagatcctgaaagtaattacggcgaagtgcaaaaattactgtttgatcatatcgagatctctgcagaaaatattcaccgtattcgtggcgaagagcctgtggaacaagaacttgcaatattttcacaagaactgaccgcttgtgtacctaatggcgagtttgattggattattttaggcatgggaacggacggacataccgcgtcccttttcccacatcaaacggatttcaatgatccaaatttagcaattattgccaaacatcctaaaacagggcaaattcgtatttccaaaaccgccaaattgattgaacaggcaaaacgagtgacttatttggttacaggggcaagcaaagcggaaattctcaaagaaatccaaaccaccccagcagaaaacttgccttacccagcggcaaaaattaaagccaaaaatggcgtaacggagtggtatttggatagcgatgcggcgaggttgttgtaaaaaatagattaatttttaagtagttatcggagctagatatggatttaatcaacagcagttatcttttagaaattaagcaaattctttctaatgcacgccaaaaggcttataccgctgtcaattcagcaatggttgaagcctattggaaaattggcgaacgtattgtgttggaagaacagaatggagctgatcgggcggcttatgggaaagagattataaaaaatctttctgttgaattaacgaatgagtttggcaaaggttttagtaaacgtagcctgtgggaaatgcgacaattctatgttttatttcctgattttccaaaagtgcgaacggtgttcgcacaattatcgtggtctcattttcagcgttcattaaaggtatcaaacgacaaagctcgtctttattatctaaaagaggccgctgaaaataattggtcggtaagaactcttgatcgtaacatttctacgctttattacgaccgcttgttggcaagccaagaccagagtatcgtcaaagcggagatgctggaaaaatccgtgccattacaagccagcgatttgattaaatcgcccactgtattggaatttttgaatttaccgactcacttggcatacaccgaagcagagctagaaaaagcgttgattgataatctgcaacaatttatgttggaactgggcaaaggctttgctttcgtggctagacaacaatgtattcgcactgaaacgtccgatttctttattgatttagtcttttacaactacattttaaaatgctttgtaatcgttgagttgaaaacagaaaagctcactcatcaagatattgggcagctggatatgtatgtgcgaatgtacgatgatttgcaaaaacgccctgatgataatcccactatcggcttgttactttgcaccgaaaccgatagcgtagtggcgaaatattcggtattgaacgacagctcacagcttttcgccagcaaatatatggcgtatttgccaagcgaagaagagttggtgcgagaaattgaaaatcagaaaatgatttttgaacaaaatcatagttaggaaaaatgatgtcaatactggcttatattttaaccacccttgtcgctcttgagcatttctacattatgtatttggaaatgtttgcattaaacagcccaaaggcaaggctgatttttaatttagatgaacaaacggcaagcaaccctaaaattcagttgttgtttgcgaatcaagggttgtataacggatttttagccgctggaattattttttccctttgtattcaacaaagtgcggtcacttatttctttttaagttgtgtgattgtggcggcagtttatggggcgataagtacgaagaataaaggggttttaattaaacagggagtgccagcggtgttggcgttggtggtgagtttgtttgcgtaaatatgtagataccataagacacaacaaattttatttcataaatgtgtctaaattaaatgctgtctgtttttgcaaaacagcctgtgcaatagtgactaatttacgcattaaagccgtgataatcaccattttaggtttgccgcattcaagcaatcgcagcacaaacgagcgatatacgctgtttttgtagctgccaaaggcaaagttcattgcagggcaaaagagtgccttacgaatgtcggattgcccgatttttgaaataccaataacggtatttaaacttttccccgaacttttaatcatcggggttaaacctgcaaaagtggcggctgctttcgcgtttttaaaacgatttccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacattgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttccatcacgcagtgaaaagtttcaccaaatgtattgagccattgcataagtgattgaaatccttctggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggctaatcacattagccccaaaacaataaagtattcaacaacccaacaggagcaaaaaatgtcagtaaaaggcgatatcggcgttatcggtttagcggtaatgggtcagaaccttattttaaatatgaacgacaacggctttaaagtcgtggcgtataaccgtactacgtcaaaagtggacgagtttttagaaggtgcggcgaaaggtacaaatattatcggggcgtattctttagaagatttagttgcgaaattagaaaaaccacgcaaagtgatgttaatggtgcgtgcaggtgaagtggtcgatcaatttattgatgcattattaccgcacttagaagaaggcgacatcatcattgatggcggtaactcgaattaccctgataccaaccgccgtgtgaaagcgttaacggaaaaaggtattcgctttatcggctcgggtgtgtcaggcggtgaagaaggcgcacgtcacggaccttcgattatgccaggtggtaatgaagaagcatggcaatatgtgaaaccgattttccaagcgatttcagcaaaaaccgacaaaggcgagccttgctgtgactgggtgggcaaagaaggtgccggtcatttcgtgaaaatggtacacaacggtatcgaatacggcgatatgcagttaatctgtgaagcttaccagttcttaaaagacggtttaggtttaagctatgatgaaatgcaagcaatcttttctgaatggaaaaaaactgaacttgacagttacttaatcgacatcacgaccgatattctaggttacaaagatacagacggcacaccattagtagaaaaaatccttgataccgcaggtcaaaaaggtacaggtaaatggacggggatcaatgcattagatttcggtattccattaaccttaatcactgagtcagtgtttgctcgttgtgtatcttcattcaaagatcaacgtgttgctgcatctaaattgttcaacaaaaccattggcaaagttgaaggcgacaaacaagtttggatcgaagcggtgcgtaaagcgttattagcatcaaaaattatctcttacgcacaaggctttatgcttattcgtgaagcgtctgaaaacttcggttgggacatcaactacggtgcaacagcgttattatggcgtgaaggttgtatcattcgtagccgtttcttaggcaacattcgtgatgcttacgaagcgaacccagatttagtgttcttaggttcagatgcgtacttcaaaggcattttagaaaaggccttaagcgactggcgtaaagtggtagcgaaatctatcgaagtgggtatcccgatgccttgtatggcaagtgcaatcactttcttagacggttatacctctgagcgagtgccagcaaacttacttcaagcccaacgtgactacttcggtgcacatacttatgagcgtaccgacaaaccacgtggcgagttcttccataccaactggacgggacgtggtggaaatacggcatcgacgacttatgatgtataaataaaatttgtctattacacctatatctgttactacgtatagatagtctaaataaaaagccaatcatagatatatgattggctttttatatgtttcttaaattagttggcggaatggacgggactcgaacccgcgaccccctgcgtgacaggcaggtattctaaccagctgaactaccactccgcagcaaacgaggcgtatattaatgatttcgttctctaccgtcaaacacttttttgaaaaaatttattgattgtctttttactatacaaaacgctctctttttaattcaatgtcgtgttttctgtcgccaattctctcgtccaaaggcaatttccttttgattttttatttatcaactcaagatatttaagatgttctgccaattccttttcatcaggggctaatacaatcaagttagaggtgtcgatagttaatggctggtaaacttgctctgctgaagatgtttttacttgctcgtgttcgtcttcaccaataagggcaatttgaccgcctgtcatcatcaggaacacatcagccaagatctccgcatccagtaacgcaccgtgcaggacacgtttactgttatcaatccccaagcggtcacataacgcatctaaattgttacgtttccctggatacatcttacgagcaagctgtaagctgtccgtgacggtacacatctgtgctactttttcagggggattcggcaaaaaggaaaactcgtggtcgataaatcctacgtcgaagggcgcattatggataatcagttccgcccctttgataaattcaataaactcatcggcaatttcagcaaatgcaggcttatccgccaacatttcgttggtaataccgtgaacttgcattgcctctgcctcgacttctcttggcggtttgatataaacgtgaaaagtccgcccagttaaacggcggttaattacttcgacagcaccaatttcaatgatgttatgcccaatgtgtggagcaccattgaaattcatccccgtagtttcagtatcgagtacaacttggcgtaatatttgttgtttgctcattgtattttcctaagttacaagcggtaggatttgcaaaatgttttacatatcttaccgcttgtgcttcaaattaactatccgtttttaattcatcaatcgctttttggtcgaagaaatattgcgtgccacaacattcacactgcatatcaattaccccctgtttttcggctaacatctctgcaatgtcttcttcaggcagtaacaaaattgccgcccccgaacgctctcttgaacaaccacatttaaattctgtggactgcggttgataaacttccactgtttcttcgtggaataaacgatagagtagttcttctgccgttaaaccaaatagctcttcatctttgatcgtcgaagttaatgtcgccaaatgctcaaagtcgtctggtgaaccagtgccatctggcacgatctgtagtaatgttccaccagcaacggctttgccttgatattcaccaacacggatcacaagctgtgtggcgagctgttctgaacgagcaaaatagtcttctaaacactcactaacagtaggtttatctaaggctataaccccttgataacgttcacctttttctggaataatcgaaataacgagaacaccatttccaaccatttcagcaagtgttgcgttatccgcaatatcaccttcaacacgagctaaagcacgaaattgttgttgatgattgccgtttaccaccgctaattttaacgctccgtcaccttgaatttgaacggtaattgtcccttcaaatttgagtgttgccgttaataaactggttgctaccaacatttcacctagcaaattttgtactgctgatggatagtggtgggtatttaaggtttccgtaaaggtgtcatttaagcgaacccattctccacgcaccgcacggttttgaaataaaaaacgataaagtttatcgttatcttgtgtgtaagttgtcattaacaatccttcataaaatacaagcggtgagaaaaatcaccgccgttacaaaacatatatggggacgatttaagtaattacaaatcgttctcttgatatttaaatttaatcaaatcccgccgctcttttttatttgggcgacgatctgggtgtggcatcgacaacgcatttgctttacgggcaaaggcgattttttctcgttcttggatacttttttccgtttcttgataaagtagttgtgcttcaggtgcaccacgtcgttgatcgctcaacgcagtgacaacaacttctttttcatcgttgccttggcgtaatttaattgttgccccgacttcgacaattttactggttttagctcgttgcccattgtaatggactttaccaccttcaatcatcgcctttgcaattgaacgagttttgtaaaagcgtgccgcccatagccacttatccaagcgaacttcattgatattatcagccatttttccccttttttttcaactattttaccctttttcacacaaacaagcggtaataaggcagaaaaaatttgcaaaattttccttttcgctgtattctccgccaccacaattcatacaaacaaatctgaattaacctgttttaatccaatctttaaataacacaattattatttctatgcatcttacagagttaaaaaatacacccgtatcggaacttgtccgtatcggtgaagaacaaatggggctagaaaacttagctcgcttacgcaaacaagatattatctttgccattttgaaacaacacgcaaaaagtggtgaagacattttcggtcaaggcgtgttagaaatcttacctgatggttttggtttcctccgttctgccgatagttcttaccttgcaggccctgatgatatctacgtttccccaagtcaaatccgccgtttcaatcttcaaactggtgacaaaatcgaaggtaaaatccgcccaccaaaagaaggcgaacgttactttgcattgctaaaagtcgatttagtcaatgatgataaacctgaagtttctcgtagcaaaattctctttgaaaacttaacgccactgcacgctaactcacgtttgcgtatggaacgtggtaatggttcaaaagaagatttaaccgctcgtatcttagatttggcttcaccaatcggtaaaggtcagcgtggtctgatcgttgcaccaccaaaagccggtaaaaccgttttacttcaaaacattgctcaaagcattacccataactatcctgagtgtgaattaatcgttttgttaattgatgaacgtccagaagaagtaactgaaatgcaacgttctgtgaaaggcgaagtaattgcttcaacctttgatgaacctgcaactcgccacgttcaagttgccgaaatggtaattgaaaaagcgaaacgtttagtcgaacataaaaaagatgtggttattttattagactctatcacacgtttagcacgagcttacaacacagtaacccccgcgtctggtaaaattctttctggtggtgtggacgctaacgctttacaccgcccaaaacgtttctttggtgctgctcgtaacgtagaagaaggcggtagcttaaccattattgcaacggcacttgtggatacaggttcaaaaatggacgaagttatctttgaagagttcaaaggaacaggtaatatggaattacacctttctcgcaaaattgcagaacgccgtgtattcccagcgattgactttaaccgttcaggcacgcgtaaagaagatctactcacaagcccagatgaattacaaaaaatgtggattttacgcaaaatccttaacccaatgggtgaagtggaagcaatggagttccttattgataaattgatggtcgcaaaaaccaacgatgagttttttgagattatgaaaagatcttaaccatagaaatagaaacggcacttaaagtgccgtttttattatagctagtttgccacagtagcgatatccgcaaacatggtataagaaataatattcaacgttatttttgtaatgaatgtcataaaacttttctttgtgaaagaaaaagttttatgacgggacgaacaaaagtatctctgaatattatttttctttccatacttttggatattgttcttaaggcaaaaaggacaggtttttattcatatttcaaaaagaaggcttaaagtcttgtactataaggctttaagctactttttagcaacaaatttatctattacgcctgtaataggcatagtgaccattttgtctactatgccttaaaaagttgcttacataaaatagtcactaatatttacaaaaatagacgcaaaacaacaatctttcagtatattgttaaattttaaaccgattatttaataccatacttctcgcgatattctctcatttttggcaaatagtcagtatattgcgctgatctttctaagaagctaacaagatcatcaaaatcaataatagagaaaacctgacagccgtaatcacgttctacttcttggattgctgagagttcgcttttgcctttttctttacggtttaacgcgatcatcacacccgctaaggttgcattgttggcttgaatgatttccattgattcacgaattgccgtgcctgcggtaattacatcgtccaccaataaaattctgccttttaacgggctaccgataagatttccaccttcgccgtgatctttaacttctttacggttaaagcaacaaggcttatctacatcaaattgatttgctaatgccaccgcgacagtagttgcaatcggaatgcctttgtaagcaggtccgaatagtacatcatagtcaatttggctagcttggatcgctttggcgtaatattcgcccaatttggcaagatctctgccagtattaaataatcctgcattaaagaagtaagggctttgtctgcctgatttcagggtaaattcgccgaatttaagtacatttcggcttaaggcaaattcgataaagtcgtgtttgtattgttgcataggacatccttcttatctagctgcaagggcggaccgatgtgttcgcccacaatattatctacattttaatagggcgaacacatcggttcgcccctaaaaacaattgtatagttataaaaatagtggggctgtattagattagtcctaaatttcacaccattttctcaacattttaagtcactcttttggtgccccaaagttaaaccgaaattcacattctttcaagaataaagggaaactttttcggtcaattccattatattttcggagtatccgcttggcttgactccaaaaattttcaatgccgttgatgtgattttgtttcactgcaaacagctccgaatggctaattcgttcgtggtgaaattcgcttacatcaagggcatcataactatggtaagtatctgtataaacccagctatcaggcttgattttccttgctataacaggcattaacgttcttattttcgtgtcattgacgactacagtaaacactttaccttgtcgttttaatatgctaaaaacagccacttttcctgccgcaccacgacctcgttttcctttacgatgtccaccaaaatagctttcatccagctcaatttgtccgtcaaatacttcatctgcttcaagggctaaatgataactgataacctcgcggattttgcggtaaaacagtgcagcagagttatcatttatctctaacaaatttgccgcagaacggacagtgacttctaatacaaaaaattcaaggagatttttttgtatggatttctttaatttacaatgagttattttcatttttatagactaacatacttgctaatctaatacggccccaaaatatttattccggcttaatccactctaccgtccaactgcctgttccttctggcacaagcacatcagttaaatagggtaaaatctttttcatttgactttctaactgccacggtggattaattacaatcataccgcttgcagtcatacctcgttggtctgagtcagggcgaacggctaattcaatctgtaaaattttgcggatccccgtttcaactaggcctcttacgatacgtttggtatgttggcgaagcaccacaggataccaaatcgcataaacgcctgtggcaaagcgtttgtagccttcttcaatggcttttaccaccagttcataatcttcttttaattcataaggcggatcgatcagcaccaaaccacgcttttcttttggcggtaaggcagattttaactgctgaaaaccgttttcacgttttgtcaccacattaggtgttttggcaaattcattgcgaagtagtgggaagtcgttagggtgtaactctgtgagtaacgctctgtcctgtggacgtaattgttgcacggcaagtaacggcgagcctgcgtaaaaacgtagcttatctttgttaatttttttgatttcatttaggtacaagacaacttcttcggggagatcggttctctcccaaaggcgagctataccttcaatatattcccctgttttttccgcttcgctactttgcaagctataacgccccacacccgaatgggtatcaaggtagaaaaagcctttttctttctgttttaaggcgtgcaaaatgagggttaaaacgatatgtttaaggacatcggcgtggttgcctgcgtgaaaactgtgatgataactcagcatttttattctctttcttgtaaaatggctctattttagcttatttagtcgttttaaactatgcagaaaacgttaaagattgaaaatggttggctgttaaataccaaacaagtaccttcaccgcactttaatccaagaccctatcaagacgatatttctcttttggtcattcattatattagcttgccccctgatgaatttggcggtgattttattgaccgtttttttgaaggcaagttagacccaacccttcacccctattttgaagagattaaagatttacgggtttccgctcactgtttaattaatcgagaagggcaaattactcaatatgtcaattttaacgatatggcttggcacgctggcgtttcttgctttgaagggcgtgaaaaatgcaatgagttttctatcgggattgagctagaaggcagtaataaccagccttttaccgaagcgcaatatcaaaccttagctagccttacgcgagtgattatgcaagcctatccgcaaattacgcctgagcgtatcgcaggtcacaatcaaattgccccagaacgaaaaatcgaccctgggcagtattttgagtggggatattacgacttactacttaggtatattcttaagtaaacccaataaaaaacgccaataaaatcggcacaaccaaattgataataaagccgaaactgattgcaagaggcacaatctgaatacctcctgatttttgaataatcggcaatgtggcatcaagtgcggtagctccgccaagtcctacggctgttgagggaaagtgacgcataaaaaacggtatcgcaaataagcagaagatttctcttgagagatcgttgaaaaaggcaatgctaccgtccattgccccccaagcatcattgactaatacgcttgaaagggaataccaaccaaaaccagaagcaaagacaagggctttaattatcggtaaatcaagcagataagcacaaagaataccgccaatcagaccgcttgcgataaaaacgatggaagtcaaaatgccacgagtatttaaaaatacatcacgcagtggaatgccgctgtttctaagttgaaccccgacacagaaaatcattaccactaggacataggtgcttgaatgtaaagggaaatcaaccacatttttagttgaaaagcctaaaattaccccgacaaaaaccgttgcacagagttgtgtcgactcaagcaaaaccttccaacgagatggcaattcttcaaggctatgagcctcacgtttgatcgggtaacacttatcaaaaatgagtaaacagacaatgttgcaaaggtgtagaattgcacttaaaccaaatgccgttgctccaatttgtggtagtttggtcgttaattcatctaattgcccaagcgaaatccccataatcaataaaatcaggtataagcagtaaagcgtaatgcgattgacccaattgagtatctgttgatttgtcgtttggaaaagataccctaagaacagtgggacaaaggcgatcattagtccgtatagcataatttctccttttgccaataaagcaaggaatgtaatagataatttaacgaagataaactgtttttatttacagtgttttattgtatcattaagaatacataagcggtcagatttctctcacggtttacaaatataggcgagcaatgaattacaacaaaaaaattattcatattgatatggattgcttttatgcttctattgaaattcgcaataatccaagtttaaaaggaaagcctgttgcagtagggggaaaagctaatcaacgtggggtgctgacaacctgtaattatgaagcgcgtaaattcggcttgcatagtgcgatgtccacttctcaagcgttaaaacgttgcccgaatttaattttattgcctgtcaatatgtcgctttataaggcggtatcagagcaaattcattgcatttttcgccgttataccgacatcattgagccgatctctttagatgaagcctacctcgatgtgaccgcttgtaagcaacattcaggctctgcaacttggatagcccaagccattcgtcaggatatttggcaagagctacaacttacttcatcagcaggtattgcaccgctgaaatttctagcaaaaatcgcttctgatcaaaataagcccaacggacaatttgttatttgccccgaagaggttgcggattttgtgaaaaccttgccgttaaagaaaatttcaagggtgggcaaagtggcccaagaaaagctggcacaacttggatttatcacctgtggcgatattcaacaagcagatcaggctttgatttatcaacagtttggtaagtttgggcaacgcttatgggatttctgtcacggcatcgatccaagagaagtcgagcctcaccgccctcgaaaatcgcttgcagtggaaaataccttactttctgatcttgatacactcactgaggcggaagatgtggtgaaatcgcactatcaaaccttactctttcggcttcaacgcaactggggcgataagccactgagcgatttaaaaaagatcggaattaaactgaaatttgatgatttcacccaaactacactagagcgaaccacagacggtatcgcagaacaccattttttacagctattacaacagatttggcaacgacgaaaggggcgaaaaattcgtttgatcggattgaatgtgcattttcctgaagaaaaaattacgaagcaattaaatttatgggaataatttttgtctaatccttgatttttgttaaataatcattatgttaagcattcggtaatcgcttattaccgaataacaacaatttattaactttggagaattatctatatgatgcgtatcgcacttttccttgcgacaaactttgcagtaatgattgtgctagggattattttaagtgttactggcattgctggaaacagtacgggtggaattttaattatgtctgtgctttttggttttgctggttctttaatctcattatttatgtcaaaaacaatggcattaaaatcagtgggagcagaaattatcactgaaccacgcaacaatgcagagcgttggttggttgaaacagtgaaacgccaatcgcaacaagcgggtattccaatgccagatgttgcaatttaccactcagctgatgtaaacgcatttgcaacaggggcaaccaaaagtaactcgctagttgcagtgagtacaggtttgttaaacacaatgacagaagacgaagcagaagcagttgtggcacacgaagtagcacatattgctaatggcgatatggtcacaatgactttattgcaaggggtattaaatacctttgttatcttcctctctcgtatgattgcaacggcagtatccagtagccgtaatgatgatggcgaagaaacccaaagtagtggcacttacttcttagtatcaatggttctggaaattcttttcggcgtattagcaaccatcattgcaatgtggttctctcgttaccgtgagttccgtgcagatgcaggctcggctcaattagtgggtaaagagaaaatgattgcggcgttgcaacgtttacaacgtgttcacgatccagaagaattacctggttcattaaatgcgatgatgattaacggtaaagcaaaagagttctttatgagccacccaccgttagaaaaacgtattgaagcgttgagaaatttatagtgagataatattattcactataatttagggtatcgaaaataatctcagccaaagatactgaaattccaggaaccgatttaatttcatcaagtgttgctgatttgacgccttgcataccaccgagatattttagcaacaaatggcggcgtttagccccaacgccagcgattgcctctaaaccactttcggtaaaggctttttgccgttttttacggtgtccgctaatggcgtggttatgggattcatcacggatatgctgaattaaatgtaacgcagggctgtcgggtggtaggtggatttccttgtcccatttgctgatcagcaaggtttctagcccagcttttcgttctacgccttttgccacgccgatgagtaatggtttggatttatcccattccactttgagattggcaaaggtgtctaaggctcgatttaactgcccttttccgccgtcaataaaaataatatcagggattttttcaggcggtagcggtttatcataacgtttgagcagggcttgttccattgcggcataatcatcgccccctgtaataccttcaatgttgaaacggcgatagtcggattttaacggtccattttcatcaaacaccacacaagaagcgaccgtttgttcgcccatcgtatgactgatgtcgaaacattccattcttgcaatttttggcaaagaaagcaccgcttgtaaagcttcataacgggtttggattcgagcatcttgcttgagctgtaaggtcaatgctgccattgcgttcgttttggcaagcgcaagataacggcttttttcaccacgcactttatcggtaatgctcactttatgccctgcttgttccgataataccttttctaaggcgtccacttcgctcacggagtgatcgataataatttgatgcggaatggtgcgatgttggttcatctgcaaatagaattgcccgataaaagtgtcactcaattcggcaaattcggtatggttcggcacctttgggaaataacttcggctacccaacattttcccttgtcgtacaaacagaatatgtacgcaagcgataccgtgttggtaggcaatcgaaataatatcgagatcgtctagacgttcattcgatacaaattgcttttcagtgaccactcgcatctgctgaatttgatctcgaaaacgggcagcagcttcaaaatccagatcttccgcagctttttccattttaccgatcaaatgttcgatcacttgctgatctttaccttgtaagaataagcgaacatactccacctgttgatcgtattctcgttgggaataaacgccttcaacgcaaggggcaaggcaacgcccgatttgatactgcaaacaaggacgagaacggtttttgtagtagctgtcttcacactggcggatcggaaacagtttttggagcagatttaaggtttctcgcaccgcccctgcatttgggtaaggtccaaaatattccccagcaatttttttgctcccccgaaagctggctaaacgagggtgctggtgtttggtgagcaaaatataagggtaagatttatcgtcacggagcaacacattgtatttcggttgattttccttaatgtaattgtgttccaacagtaaggcttcggtttccgaatgggtaatggtggtatcaatatgagcaatttgcgagaccaacgcttcggtttttcggctggcaagattgctacgaaaatagctcgatagacgcttttttaaatcttttgccttaccgacatagatgatcgtgcctttatcatcatacatacgataaacaccagggttatgtggcgtatcggcaagaaattgtttggaattgaattttgacataatcaacatttccccctttgaaaaagggggatttaagattttaataaactgcctttagatgctttcaagtattgcaacatcgaccaaatggttaaaatcgcagcgatatagagcaaagcaaaggcggcatattccatccacgctgtttgtcgccataataaaccacccaatgccaacatttgtgcagtcgttttcactttaccccaaatcgacaccgctacactcgcacgttcgcctaattccgccatccactcacgcaacgccgaaataataatctcacgggcaatcataatgccagctggaatagtgatccaccaagtatggtagtattcgaccacagacaccaatgcaatcgcgattaaaactttatctgccacaggatctaaaaatgcccctaagcgagtagtttggttccacttgcgagccaaatagccgtcaaaccagtcagtaattgaagcaataaaaaaaatcaacgtggtaatttcagcagaatattgaataggcaagtaaaacgaaacaataaacagcggaattaacgccacacgaaataaagtcagataggtcggaatgttgagtttcatacgttacaggtcgaataaggtattctctatattctattataaagtagatgaaagaagaaagcgataatgccataactcttattatttttctaaatagatagataaaaagaataaatattgtagaatacggactatgatagtgaatgaaatgttaatattttctttttcccaacaagaacttaatgccatttatttaagcctaaaaattgccagtatagcggtcttatttgcgttgccttttgccattggggctgcgtggttgttggctcgaaaagagttttggggtaagcatttatttaatggcattatccatttgccgttagtcttgccccctgtggtgatcggttatcttttgctgattttaatggcaaagaaaggggcgattgggcaatatttgtggcagtggtttgagttttcgttaagtttttcttggaaaggggcggtgcttgcttcaatggtaatggcttttccgttgatggttcgctctattaggttagcctttgatgctattgatccaaaattggagcaggcggcgagaaccttaggggcaagtccattaagagtgttttttacacttcatcttccgctctctttttcggggattattgcaggggcggtgttaggttttgctcgttcgttaggggaatttggggcgaccattacttttgtgtccaatatccctaatcaaacccaaactattcctgcggcactttatacgtttattgaaacccctgacggtgaaatggcggttgctcggctttgtgtgattgcgattgtgatttcgttagtggcgttatttttttctgagttattgtcacaacgtcagcaacgtttccaacaaattaagggacagtaatggcacaatctttgcaacttaaagttaaacatcgtttaggaaacttggatttagctgttgatgtggcgttaaatgctaaaggggtgacggcaatttttggtcgctctggggcagggaagtcgagtttaattaatcttatcgcagggctagttacaccaacggaaggacgaattgtgttaaatgggcgagtgttgtttgatgatcgccagaagataaatttgccgcctgaaaaacgtaaggtgggctatgttttccaagaacatcgcttatttccgcattatcgagttgaggcgaatttaaaatatggctgtaagcggtttgatcaggcgaatttttcacaattagttaaattgttggggattgaacatctgttagatcgtttcccgatcagcttgtctggtggtgaaaaacaacgtgtggcgattgggcgtgcgttgttgagcgagccagatattttgttgatggacgagcctctttcagctttagatttaccgcgtaagaatgagttgatggactatttggggcggttggcaaaaacggtggatattccgattttgtatgtaagccatagccttgatgaggttattcgtttggcggataatttgttgttgttggaagaggggaaggtggttgcttttgataaaacgttgaatgtttggcatagcccagccttttctgcgtggcagcctgaagctcaacggttgagtttacttgagctgcctgttgtcgctcaaaatccttaccgtatgcaagggctggcattgggacaacagttaatttgggttacggaacagcctcgctatcaattaggggatttaatgcgaattagcattggtagccaaaatgtttctattaccctgtctaaacctgagcaaagttctattcggaatattctgcaagggcgaatttgtaaaatcgagcctcaatctgaccgctatgatattgccgttgaggcggaagctcaagaaatttgggcgagtatcagtttgtgggcgtttgatgatctgtgcttgcaaatagggcagatggcgtatttgcaggttaagagtgtggtgatttagattagattcttaatttttctatatatttgaatggtattttttatttaccaagctataaaggagtttgataagcaacaaggctacatttaaaaatagctattacgaggtcgctgtaatttgcgatagatcaaaaaaatatatattatcttcttattatttgttactatagttgagagtttacactcaattgttactgattatttttgaggaacataatatggcatacacattacctgagttagattatacctatgatgcattagatccgtattttgatgcaagaacaatggagattcatcactccaaacaccatcaaacctatattaataatgcaaatatcgcattagaggcatatcctgatttactaggacaatgtccaggaaagctgatctcaaatcttgagcaagttcctgtagaaaaacgagtagctgtgcgtaacaatgtaggaggacatgttaatcacacgttgttttggaaagggttaaaaactggtacgaccttacaaggaaaactcaaagagaccataatacgggattttggttctgttgaaacattccaagaacaatttgagctggctgctaccactcgttttggttctggatgggcgtggctagtactagaagatggaaagttatctgtagtatcgacagctaaccaagattctccgttaatgggtaaagatgtagctggtgtgtctggttatccaattttaggtttagatgtatgggaacatgcatattacttaagttaccagaaccgtcgtcctgattatattaaagcattttggaatgtggtgaattgggacgaagcagccagacgttttgaatcccaagcataacgcaactgtgagtagtgtatggttgctaatgaatattttaaattattcttagcaactctttttatttaaaaaatcctttataaacataacattatgtcttttcgttaatcctgcatgatgcgataatttctctttaagttgtccgaataaattttcaagtctatttgtcgttttttcgatatttaaatcactatacttttcataggtaaataatccatataatgtttaaaactatgataagcacttcttacattccgatgcctataaggataataactctttttgttcgatttatctgaccgttcttctaaaacgcttgatgttttaaataccaataatgtaagggggcgtattagattagcaagtatgttagtttataaaaatgaaaataactcattgtaaattaaagaaatctatacaaaaaaatctccttgaattttttgtattagaagtcactgtccgttctgcggcaaatttgttagagataaatgataactctgctgcactgttttaccgcaaaatccgcgaggttatcagctataatttagcacttgaagcagatgaagtatttgacggacaaattgagttggatgaaagctattttggtggacatcgtaaaggaaaacgaggtcgtggtgcggcaggaaaagtggctgttttggggatattgaaacggcaaggaaaagtatttactgtggtagtcaatgatacgaagacaacaacgccaatgcctgttatagcaaggaaaatcaagcctgacagctaggtttatacagatacttaccatagttatgatgcccttgatgtaagcgaatttcaccacgaacgaattagccattcggagctgtttacagtgaaacaaaatcacatcaacggcattgaaaatttttggagtcaagccaagcggatactccgaaaatataatggaattgaccgaaaaagtctccctttattcttgaaagaatgtgaatttcggtttaactttggggcaccaaaagagtgacttaaaatgttgagaaaatggtgtggctaatctaatacagccccttaaattattattgaattgatatgttaggtattcattcatctaaaccctcaccccaaaccgcttcggcacgataaaaatcgcaggcagtgcaaacaacaccattaaccagaagctacctgtcggcgaaacttgatagactaagccagcgataaaggtgaacaacgccataaaaatacagcttgcaaagctaaaatagagtgcttgtagttttgccatttgttccgtgggttgggttgaaaggtagcggatcattgcataatgccctgctccataagagatagaatggaacatctgcattgtcattaagatcgccatattggtggtggaagccagtaaaatccaacgcaccattgagctaatggcagataagatcattaaatggctgattttccacgttttaaatacacggttggcaaagaagaaaaacagaatttcagaaacagctgccaatccccataacaaactcgcactttgggtcgaaatgcctgccgatgcccaataaatcgtactataagcataataagcggcgtgagaagattgaattaaggaaacggcaatcaacattttgaatgtggttggcactttcattaattgcagatagcttaaatctgattgggctttttcttccgtttgtacaaaggtttgggtcggattgaccgttaagccagtgcctaaaaagactagccagccgatcaaaatgccgataatcgcactttcccctagccagccgactaaatagcctgtgctaactgagccgaccacaaaggcaatcgagccaaacaaacgtgttctgccataatcaatcccgacttgctgttgccaagtggaagctatggtatcagctatcggcattgctccgccgttgaagatatggaacagtgcgattgcagggaataaaatccaaattgtttgtaccccaaaggcaactaaaaacagagtggcaatggcgagccacgttagccaacgagcaagagaaagtagctggttggggagggtaatgcgtttagaaaaggtcattgcccctaaaaagcggaatagataacctgaagcgattaacaagccaatcattcccgaatcgtagccgtgatggttcaaccaaacaggtagaaacggcaacagcacgccataggcacagtaaaagccgaagaagttaaacgacgaccattgaaaaggggtaaattgtatcatagagatttttccatctcttctgcacgtttaattgccgcattcatcgcttgttcaacggttgcatttagctcacgttgttcaaataccgccaatgcttgagccgttgtaccgccttttgaggtgacattttcgcgtaaggttgctaaggtgacttctggattttccaccaccatttttgccgctcctaaagccaccgattgtactaaataacgggcatcttgttcactaaagcccattttaaccgtagcttcttgcattgcttccataaacttaaagaggtaagcagggctagaacctgtgatggcaataatttggttgatctccgcttctgtatccacccaataacatttacctaccgcagacattagctgttctgcaaattgacaagcggtctgatctaccgatttttttgcaaagaatcctgcaatgccttcaccgatgagcgatggcgtattcggcattgtccgaacaatgttgcttgctgttggtaacagttgctcaagacgagcaacagaaattccagccgcaacggaaatcacccattttgcacgaaaatccacttgagcaaactcactgcacacttccgccatcatctgcggtttaactgccaaaatcactacgtcagcttgggtcacagtatcaaggttagacaaatccacctgaacgcccattgctcttaactgcgagcggcgagtttcattgcttttattacgagcgataatttgctcggcaggataaccgcttttgattaatcctgaaatgatcgcaaacgccatattaccagcacctataaaggcgatttttttgtgttgcatttgttcctccaatcatcaaaatcttccagatttattgacatgaaatatccacataccatataaatagatagcaatattattgctttataacattttccatactctgttcatagaaggtaatttcttgcgaagaaaatcaagcattacttgtttaatttatatataaaaatataatttattaatggagaagaaagagagagtatcttagaacttaattcaactataaaaggttattatcatttaaaaatcacatggcattgactaccagagaccctatcccaaattctgtgtaaacacccatttcaacttaacggtgatcgtctaagcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcgggtcagattttcgcgagcctgtgcttccgtcggggcctgataaacctgctttaaatctgcggtgacggctttgtaatctttccacgaaacgaatttcaagctgttacgcactaaatgcacaatgcaaagctgaatcttcgttttaggatagactgcattgatggcttctgggaagccttttaaaccgtctacacaggcaataaaaatgtcttttaagcctcgattttgaagctctgtcagcacattcgcccagaacttcgcaccttcattttcagcaatccaaagccccaataactctttatgtccttcaagattcacacccaaggcaacaaacacggatttgttgataattcgtccatcttggcgtactttcactacgatacaatctaggtaaacaattggataaaccgcatcaagtgggcgattttgccattccattacgcgttctttcacggcgtcggtaacgcgagaaatcaggctgcttgacacatccgcatcatagagttctttgaacatttcaacgatttcctgattacttaaccctttggaatataaggcaataatctgctcatccattcctgtgatacgggtttggtttttcttgataagttgcggttcaaaggtgccgtcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctcctaccagaagatacaaatagcattcagtaacaccttaactttaattccgtgaaatatctgcctctaggagctattttctttaattaccaagaagcagataaccttaacattcattaaggatttctccactattacctttttacagattatttaaacgcacatcaattagcatttgatttgcatcacccgctttttctttggcttgctcataagcacttttcgcagccgccttgtcgccttttgcggctaacagatcacctgttaataactgcttacggaaatcccaagcggtgtctttgatttgagaaagtgttgctaatgctgcatcaaactcttttagctgataatccactgtagcaagacgaaaacggatcacgttttgtaatgttgcatcggttgtcgaacctaaagactgtgttaataacgtttttgttgtcgcaaaatcgcctttatctgccgcttgttttgcttcttcgagttgagcaaataccgcgtaacttgagtctttattctccgcaataaatttttgtacaagcggtgcgtttttttcaggattttgcaaatagctttccatcacttgttggtagctggctgatgtggtttgagctacttcaatttggtgtttttgccagtagttccagccaaatgttgctgctgcaactagaaaaattgccacaacaatcggtgtgccattttctttaaaccagctttttgcttcttcaaactgctgttcttcggttttattaagataatcgctcatttctgctccttatgcaaaacgcgttgttaattcgttgattaaatcagcttgggtaatggtcatttgctccgcttcaccaaataggtcttttactaccactttctgctcggcgacttcactttcacctaacaccaaagcaattttcgcccctgatttatcggcacgtttgaattgttttttgaaattcccaccacttgtatgtagcattgtgcgaagttgtgggaacgcattacgcaaggtttcagtcaaacggaatgcaactgccgttgtgccttcacctgaatgaactacataaatatcaacagctcttggtaattgcacattcgggttcacttcttgcactaacaagactaaacgctctaagcccatagcaaagccaacaccttccgttgcgtgtccgccgagttgtgcaactaagccatcatagcgaccaccgccacaaactgtaccttgcgcacctaatgctgtggtgacccactcaaatacggttttattgtagtaatccaaaccacgcactaatttttgattgacttcgtaggcaatacccatttcatcaaggattgcacaaagtttagcaaaatgtgctttcgattcatcatctaagaaatcgtgaagttttggtgcatcgtttaatactgcttgtaacgcttgatttttggtatccaaaatgcgtaatgggttggttgttaaacggcgttcgctgtcaggatcttgctttaatacgtctaaatgattttgcaagaaagcaactagagcttcacggtatcgagtacgcacttccaatccgccgattgagttaagctgtaaagtgacgtgttcacggatacctaatttttcccataagcgagcggttaacacaattaattccgcatccgcttcagcatttgggatcccgaaaatttcaacgccagcttggtggaattgacgataacgacctttttgcggacgctcatagcggaacatcggaccaatataccatagacgttgttcttggttgtaaatccaaccgtgttcaatcgccgcacgcacgcaacctgccgtaccttcagggcgaagagtaaaactttcgcctgcttcttcgctacggctaaaggtaaacatctctttctcgacaatatctgtcgcttcaccgacgccacgtttaaataagtcggtggattccataatcggactacgcatttctgtgtagccataacttgcgaaagtatcacggatattgctttcgacccactgccataatggtgtttcagttggggaaaggtcattcattccgcgtaaagcttgaattgtttttgacacgttgttgttcctaaattctcaaataaatagattttacatcaataattttatgtggattttaacactatcattttagaacagtatattttcaggcgcaatcattatctccctaaacataccgtaagctccaaaggttggcttcctttatttgatagcaccactcaatgatacaaaacgacgatatttagaaaaaataaagagatcctacataggatctcttttgtatgaaaattaagcttttgatttagtgtacttgtgaatagtattaatctttcttacgcagaactaactgacttaataccactaacgcaagtgagaatacaatcataatagtcgctaacgcattaacttctggggttacccctgttttaaccagtgagaaaatcttcaatggtaacacttcatagcttgcacttgttacgaaagaagaaaccacaacgtcatctaacgagatggtaaaactcaataaccagcctgaaacaatcgcaggaagcaacaatgggaataagattttacgcaaaatggtaaattcattcgcccctaagtcttttgccgcttctaacattttcgcatcgaagtcgtttaaacgtgaggataccgtcacaaccacataaggtaagcagaacgtaatatgtgcaaataataaagaccagaagcccaacgctacaccgactaacataaataaggcaagtaaagatactgccattacaatatcaggtgacatcattaccacaaacaacataccaccaacaaattgttttccacggaaacgatagcgatagagtgcaatcgccgttaatgcaccgattaacgttgcgagagtcgctgagaaaaaggctatggtaattgagtttgttgccgcttgagttagcgtatcattgttaaataaacgctcataccagttccagctaaaacctttccagcttaaaccataacggtcagcattaaaggaattgatgattaaaatgatgattggaatgtacaagaatgcgtacacgacaaacataaaaaagcttttcaatacgcgattcattattctaactccattttcttattcatcagtttatttgcacggtagtacacataaatcattaatgccatcaagacagttaatgcaatactgattgcagagccaaatggccagttacgcgtgacaaggaactcacttttaatgatattacctacaagcaatactttcgcaccgcctaacaagtctgccacatagaacatacccattgcaggaagcaaaactaataagcaacccgccacaattcccggcattgttaatggaataattactttaacaaagcgttggaacgcattcgcacccaaatcttttgctgcttctaataaacgtccatcaattttttcaatcgaagaatagagtggcaaaatcataaaaggcaataatatgtaaaccaaaccgataatcaccgcaatttcggtatttaatatacggattggctcgctaatcatacccaaagatagcaaggtttcgtttagaacgcctttaacgccaaggaaaatcttcattccgtaaatacggataagcgagttcgtccagaatggcaacaccaccaaaaagagcaaaaatggacgatatttcgcaggcaatttcgcaatcataaaggcaaacggatagcccaccaccaaacaaataatggttgcaatcccagccatacagagcgagttccacaatacttgtgagtaaagtggatcaatcaaacgaccatagctttcaagggaaaacgtaaattcaatcagattactactgtctttggtcataaaactggtgaataacaccagtaagttcgggattaatacaaagaaaattaaccaaccgaagataaccgctacagtaacattttgaaatttcttactagcagtcttcatcgtcgagtacaacctcccagccttcgtgccacgttaatgccactttttgtcctacagagtgatccatatgcggatcgtcttcattgaagaactcgctcactaacactttcatttggttatgatctaacaccacattagactcaagggtcatacctttataagtacggtcgctaacgtgtccaatcaccgcttttgcactttcgttttcatcaagctcttcaatcacaatatcttctggacgaagcaatactttcagtttttgatttggatgaacaggtaatttcgtatgaatttcgcaaatacgaccttccacattggcttttaccgttttttctgtcacacgctcaatcaccgttgcatcaaacacattgatttcgccgataaaacgcgctacgaacaagttacttggttcttcatagatctcacgaggcgagccatcttgttggatcttacctttgttcattacgataatacgatccgacattgttaatgcctcttcttgatcgtgggtaacgaaaataaaggtaatacctaattgacgttgcaactgttttaattcgtgttgcatttctttacgcaatttatagtcaagagcagaaagcgattcatctaataacaacactttcggctgattaaccaccgcacgagcaatcgcaatacgttgttgctgacctcctgaaagctgtgacggcttacgcggtgccatttcttccaaacgcaccatacgcaacgcttccattacacgaggcttgatttccgcttctggcactttttgcatacgcaaaccgaaagcgacattatcaaaaatggtcatatgagggaaaagtgcataactttggaaaaccgtatttactggacgttgctctgcatcaacattcgatacatcttgtccgtcaagaataattgaaccatcagttaaatcttcaaaacctgcaattaaacgcaataccgttgttttaccacagccagacggaccaagaatggttaaaaactcaccgtcattaattgtaagatctaagccatcaataattgttttttcaccataacgtttcgttatagaacgaagctcaataattggtttttgctctaacttttccattgatttttgttttccccctagggcataaattgagaaaatgcaaaaaaagctgactaaaaattcagcacctagcaacataataaatatgttcttgaaatagcttgcaatgatatagcgaatgggggggggaatgaaagcaaaaatttgcaattttaaggaaattattgaagtatcttctcataatttcagaccaactttgtctaaagttttccatagtaagtttaatattaggcttagatgcattacaaaatcgctagattgttgcataatattgttacaagatggaagtatagaaacttaatacaaataattattgagttgaattgcataattatgcataataatcaccaagacaagcggtgagaaaccgccttttatttgcaatttaatttataaaggatactggatatggcactttggggtggacgtttcacacaacaagcggatcaacaattcaaatatttcaacgattcattacgttttgactaccgcttggcgttacaagatattgacggctcaattggttgggcaaaagccattcattccgtagggatcatcaatcaagcggaattagtcgaattaattgcggcgttaaagcagttgcgtgcagaagttgcccctaatttagccattgtgctacaagaagatgcggaagatattcatagctgggttgagctacaactgattaaaaaagtcggcgatctcggtaaaaaactgcacacaggacgtagccgtaacgaccaagttgccgtagatatgaaattatggtgtaaagcccaagtgctttcactacaagagtctatccgtgcgttacaagaaaaattggtggaaaccgcagaagctaaccaactttctgtaatgccaggttatacccatttacaacgagctcagccgatcacctttgcccattggtgtatggcatattacgagatgttagaacgagattgcagccgtttaaccgatgcttataaacgaatgaatacttgcccactaggttcaggggcgttagcgggtacggcttatgcaatcgaccgtgatttactcgcacaagatcttggatttgaaaccgctactcgcaacagcttagacagtgtatctgaccgtgatcacgttttagaacttttagcggcggcctctattagtatgatgcacctttctcgttttgccgaagatctcatcatctttaacagtggtgaatctcactttgtcgaactctcagatcgtgtgacttcaggttcatcattaatgccacagaagaaaaaccctgatgcctgtgagcttgtgcgtggtaaaactgggcgtgtgtttggtgcgttaagcggtttattagcaactttaaaaggcttgccgttggcttacaacaaagatatgcaggaagataaagaagggattttcgatgcgattgaaacatggcaagcgtgtgtcaatatttcagcattagtgttagaagatattaaagtcgatactgagcgtaccaaagaagctgcacagcaaggttacgcaaatgcaacagaacttgcagattacttggttgcaaaaggtattccgttccgtgaggcacaccacattgttggtgaagcagtagtttatgcaattagccagaagaaagcattagaagagctaaatttagataagtttaaacaattccattctgtgattaatgatgatgtttatccgattttatcgttagactcttgtttgacaaaacgctgtgccaaaggcggcgtgaacttagagcgtgtagctgaagcgattgccgcagcaaaacaaaatctaaatcaataataagaatagggatgtatcgttacatcccttttgtctatataaaaggagcaaatatgacaaaacaacttaccccagagcttgtattggtcgattacaaccaaattccagtgcttgaaattactcacccgaaagtgaaagcgaaggtggctttacaaggtgcgcatttattgagctggcaacctgttcatgctgagcaagatgttttttggctcagtgaagttgagccgtttgagcaaggcaatgctattcgtggtggcgtgccgatttgttatccgtggtttggtggtgtaaaacaacccccacacggtaccgctcgtaatcgcttgtgggagctatctcactatcaagtccaaacggatcaggtcaaacttgagttcagtttgtttgatgaaaaccagcaattagaagcaaaaatggagatggaattagggctaacttgtcagttgcgttttacccatttagcccaaggcgaagcacaagtggcattacatagttattttaatgtcaaaaacattgagcaggtggaactgtttggcttaccagaacagacctttaattcccttattcagcaacagcaagcggttagttcgccacgcaaaattgcagaattagttgatgagatttatcgtgctaaccaacaaccaacgctgatccaagatcttggctattcccgtcaaatgatggttgaacatcaaaatgccagcgaagtagtggtttggaacccgtggcataaggcaatgagcggaatgagtgaaacgggatatcgaacgatggtttgcgttgaaactgcacggatttatcaattagtgcaatcaggtgaacaagttagcgtgaagattagcgtcaaatccctgtaatttatgatatgatttaccctatcaagcccgatagggcatttttattttgagagaatagtatgacaatgttaaaaaatgatcgttatttaaaagcattattgcgtgaacctgttgatatgacacctgtttggatgatgcgtcaagcagggcgttatttgcctgaatataaggcgacccgtgcagaagcaggggattttatgtcgttatgtcgcaatgcggatttagcgtgcgaagtgactattcagcctttacgtcgttatgcgttagatgcggcaattttattctctgatattttaactattccagatgcaatgggattaggcttaagttttggagcaggggaaggccctaaatttgctcgtccgattgagcgtaaagccgatgtcgatcatctgcctattcctgatcctgaacaagaactgcaatatgtgatgaatgcggtgcgtaccattcgccgtgagttgaaaggcgaagtgccattgattggtttttcgggcagcccgtggacattagcgacttatatggttgaaggtggaagtagcaaagcctttaccaaaatcaaaaaaatgatgtatgccgagcctgcgttgctacacgctctgttagacaaactggctgacagcgttattctttacctgaatgcacaaattaaagctggttctcagtcggtaatggtctttgacacttggggtggcgtattggcacaccgtgattacaacgaattttccttacgctatatgcacaaaatcgtcgatggcttaatccgtgaaaacgacggaagaaaagtgcctgtgaccttatttacaaaaggtggtggtctatggttggaagctatcgctgacacaggttgtgacgcagtaggattagactggacggtagatattgctgatgctcgtcgtcgtgtcggacacaaagttgcattgcaaggcaatatggatccaagcgtactttatgcaagccctgaacgtatcgaacaagaagtcaaagcgattttagctggctttgggcaaggctcaggacacgtcttcaatctgggacacggtatccatcaagatgttccgatagaaagtccgaaagtgtttgtggatagcgttcatgccttttcacagcagtatcacaaataaggataacgaatgagaaaccctattcataaacgtatcgagcgttttgaaacttggcaacatcttacctttatggcgtgtttatgcgaacgtatgttgcctaactttcaactcttttgcgaggtcagtaagcggtcagatgatgctaaaacttttcaaaatattctcaatttagtctgggaacatttaactgtcaaaggggcgaaaatcaattttgagaaccaactcgaaaaattggaaagcattattcctgatgtcaatgaatttgatttttacggcgtattccctgccgaagatgcttgccaagcattagcagaagttttacatagtattatcgccggagaaacattagagcaggcaattaaaattagccaaatttcactttcgactgtggcaacctatttagaaacacaagctgatcgcagtttaaatgaacaagaactgaaaaatgcaccagaaattcaagacgaattagatgtgcaatggcaggtttatcgtttgcttaatgaatgcgaagaaagggacatcgaacttatcttagggttaaaaaatgagattagaacgagtggaattagcaatgttgggttaaattttagtcaaaaaatgtgatttagctaacaatttttgcattatttgctttgagaatcgggcagtttgaattaagctacacaccgcattttgcaattttatttggcaattaatgccatcttaactgatacacatctttagaggataaaactatgaacaaaactgagttagtcgatgcaatcgcagcaggtgcagatttaagcaagaaagatgctaaagcagcattagaagcaactttaaacgcaatttctgaaagccttaaaaaaggtgattctgttcaacttatcggtttcggtactttcaaggtaaatcaccgtaaagctcgtacaggtcgcaatccaaaaactaacgaagcaatcgaaatcccagcagctaacgttccagcattcgttgcaggtaaagcattaaaagacttagtaaaataattcctttacaaagtgttttgctagaagcctagagaatatctaggcttttttgcgtttatcagattgtgattttccgttacaatagcgatatttgaaatacagataaacaaaacaatgaaagcatctattattaataaactagacagcctaagcgaacgccacgaagagctacaagccttattgggcgacgcaacaatcatcagcgatcaagaaaaattctgtgcttattccaaagaatactctcagttggaagaagtggttagcacctttaatcgttggaagaaattacatagcgacatcgaagaagcacaaatcttacttgatgatcctgatatgaaagagatagcagctgaagagattgaagcaaacaaagctgaaatcgaacagcttgagcaaaacttacaaatcttattactaccgaaagatccgaatgatgaatataactgtttccttgaaatccgtgctggcacaggcggtgatgaagcaggtattttcgcaggcgatttataccgtatgtacagccgctatgcggaaagcaaacgctggagaattgaagagctaagtgctaacgaaagcgaacaaggcggatataaagagattatcgtcaaaatcagtggcgaaggcgtttacggacagctcaaattcgagtctggcggtcaccgtgtacaacgtgtaccaaaaaccgaatcgcaagggcgtattcacacttccgcttgtacggttgcagtaatgcctgagttaccagaaagcgaaatgccagaaattaaccctgcggatctgcgtattgatacctaccgttcatcaggggcgggtggtcagcacgtgaataccactgactctgcggtgcgtatcacacatattccgacaggcattgtggtggagtgtcaagacgaacgttcacaacacaaaaacaaagccaaagcacttgcggtacttgcatcacgcattgtccaagttgagaaagagaaacaagctcaagagcaagcggatactcgccgtaacctactcggctcgggcgaccgctcagacaaaatccgtacttacaattacccacaaggtcgtgtaacggatcaccgcattaacttaaccgtttaccgtttagacgaagtgatgaacggcaaaatcgacgagttaattcagccgattattaccgaatatcaagcggatcagttggcggcgttgtcggatcagaattaatctattcttagggggagaaatcccccatattgagatattctctatggctcaaattcactcgcaatggcaattcggcatcacaccaaattatttagccacattagttctggctggtaaaaaaacagcgacttgctctggcaaaatgttctattcccttgaaaatggagataaatatcctgttcaagatgaattgcatactattttagatagccaaaatcagcctttagtgacaataaaattgacggaagtgacttttaataccttaggcaaagtatctgaagcctttgcaattgcagaaggcgaaggctctttggatgaatggaaatcgttacatcaacatttttttagtcaacaattaaatcaaccgattagcgatgaatttgagctcgtatgtgaacgttttgaagtggtgaagatttttagtaaaacctaccaacaatggctcacttttgccgaacaaaccctgcttgaaaacggatcacaagatccgtttttaaacgccaaagccgatgccaacattctgctacaagcggtaacaaaacgttcaaaatctgcaatttttgcttttgctgaaacagaactgaacgaaagcgagctacgccaacttgccgagctactcgctcgccgagccaaaggcgaaccgatggcatacatcttgggcgaaaaagagttttggtcgttgcctttggcggtatccacggcaaccttaattccccgccctgatacggaacgcttggtagaagttgcgttggaatgggcatacaagcggttagattcaagtaaaaatttgcaaattcttgatcttggtacaggaacgggggcgattgctttagcattagcgagtgaattgggaaccaaagcagagattattgggatagataaacagcctgatgcggtgcaactggcagagaaaaatcgccagaaattaggatttgaaaatgtccgctttttacaaagcgattggtttgaagccttgaaaaatcaacgctttgatcttattgtgagtaatccgccttacattgataaagacgatgaaaatttaacacaaggtgatgttcgttttgaaccattaaccgcactggttgccgaacaaaacgggctgagcgatttgcaaaaaattatccaaaacgcaccgctttatttaaccccaaacggggcattaatgttagaacacggctggcaacaagctgcgagtgttcaagatattttccaacaaaatcaatggaatgcagtcactacgttccaagattatggcggtaatgatagagtaacagtagcaatatggacaacataattaacgatattttccaagagattaaaaagcctaaaagcgtggtaaataaagttcagcttcagaaatttctttaccatgagttagttcgcttaaccttgatgattgacgataacctgtctgaaccgcaggtgttaggcttgatgtcggcacttgtaaaaagagctcgctatgatgtgaatggggaaagcgatgaagaacgtttacaccaactattgagattggtttatcaagaatggggctttcattgtcatcacgctgagtatttctatacagataacctattgattaataaggttattcgtaaatttcgtggaatgccggtctctttaggggcagtggtgctttatttggcggcttcgctgaatttacccttgtaccccgtcaatttcccgacgcaattaattttgcgtgctgaattgaaaaatgagcaaggcagaacagaggtgaaatttatcaatccgtgggatggctctgagctaagccgtgaaaaattggaaaaatggctcgaaggggaaatgggctacggcgtagaattaaaccaagagtatttgcgtattgcggaagaagatgagctattagagcggttagaaacggtatttaaaatggctttaactcgtgaaggtaaatatgaagaagcactgcgtttaatcgaatatcgattgaccattagccctgaagatccttatgaaatccgtgatcgtggaatgattttagcgagtatggattgctatcaagcagcttttgatgatttaagctattttatcgatcaatgccctgacgatccttctgcaatgatgttaaaacttgaaattgcagggcttgagaaacagagtaaggcgagtgtagtacactaattttaatttaaacaaggatactttatgcaacaaaaaacaatctctctcggcaatatcgacattgcaaatgacaaacctttcgtattatttgggggaatgaacgtacttgaaagtcgtgatatggcaatgcaagtctgtgaaaaatatgtcgaagttacgcaaagattaggcgtgccttatgtctttaaggcttcattcgacaaagcaaaccgctcatctattcactcttatcgtgggcctggtatggaagaaggtttaaaaattttccaagagttgaaagacacattcggtgtcaaaatcatcaccgacgtacacgaaatctatcaatgccagcctgttgcagaggtggttgatattatccagctacctgcattccttgctcgtcaaacagatttagtcgaagcaatggcacgtacaggtgcagttatcaacgtgaaaaaaccacaatttttaagcccaggacaaatgggaaatatcgtagaaaaaatcgaagagtgcggtaacgataaagtgattttatgtgaccgtggcacaaactttggctacgataatttagtcgtggatatgcttggttttaacgtaatgaaaaaagtgtcaaaaggttgcccagtgatctttgatgtcacccactcattgcaatgccgtgacccatttggcgcagcgtcaggcggtcgccgtgatcaagtcaccaaacttgcccgtgcaggtatggcgattggtttggcaggtttattcctagaagctcatccagatccaaacaaagcaaaatgcgacggtccatcagcccttccgttgtctaagttagaagcctttgtttctcaaatgaaagcgattgatgatctcgtgaaatcttttgaagagattgatacgtctaattaagtttatctgtaggggcacactacataagcggtcacttttaggaaaaattttgcaaatgtgaattgggagaataaaaatgaaacagtccattcgccacaataaaattatcgaattggttaatcaattaggctatgtcagcacggaagagcttgttgctcaattgaatgtgagctctcaaacaatccgacgtgatctgaatgaacttgccgaaaataacttaattcgccgacatcacggcggtgcaggtgcgccttctaccagtgaaaatagcgattacattgaacgtaaacggttcttctctctgcaaaaagagtgtatcggaatgaaagtcgctgagatgatccctgatggtgcttcactttttattgacattggcactacccctgaagcagttgcctttgcactactttcccataaaaaccttcgaatcgtcaccaataatttaaacgccgctcatatccttaaagaaaaagaagattttcaaattacaattgcaggcggcggtttacgcaccgatggcggtattattggcgaagcaaccgtcaatttcatcaatcaatttcgtttagattactgcattttaggcattagtgcggtagaatctgatggctcaatgatggattatgattaccacgaagtacaagttaaacgtgcgttaatgcgaaatgctcgcaatgtggttcttgttaccgatcattccaaatttgctcgcaatgcgattgtgcgtttaggtgatgtcagagaagtgaattatctctttactgatcgcccattgccaatagaattgcaaaaccatcttattcacagtgatgtcgctgtgcatatttgtaacgaaaaataagaatgaaatcacattttagtcaagacaaatggttggcttatatgcaattaatgcgtttagataagccaatcggtacttttttattactttggccgaccttatgggcgttatttgcagtggcagatggcgttccgcctttacctattttaatcatctttgtgcttggcgtaattgtgatgcgtgcggcaggctgtgtcatcaacgattatgctgatcgctatattgacggtaacgtaaaacgaacttcacaacgtccacttgccacaggcagagccacagcaaaagaagccaaaatactctttgccacactgatttttattgcctttctgttggtattacaattaaacctttatactctcggcttatctgtgattgccgttgctttagccactgtttatccttttatgaaacgttacacacatttaccccaatttgtactgggaatggcgtttggttggtcaattccaatggcatacggagcggtaagtgaaaccttacccctagagtgttggctactcttttttgctaatcttgcttggacggttgcctacgacacccaatatgcaatggtggatagagatgatgatttacgaatcggtgtaaaatcaactgcaattttatttgctcaatacgacaacaaaatcattgccttattgcaagcaaccgcattagccctactcacgatttttggaaaaataagccactattcaaccgcttactttattgcgttagggataactgctaccttatttatctaccaatgcaaactcaccaaacaacgtgaacgagaagcctgtttcaaagcctttttaaataatcactatgtgggaatggggatcttcattgcgattttaatcggcatttataccgcttaatgttggaaatagtgttgaaaataaaaacaaccgattgaaatcacacgatttttgcttgcaaccttaaccgaagccccctataatgcacccattcagcttgccagtgtggcgaaatcggtagacgcagcggattcaaaatccgccgcccataaagcgtgtcggttcgagtccgaccactggcaccaacattcaattaaaccgctttttagcggtttttttatttcttattttttcttacattttcatacaatagcaccttaccgcacaaggcttcaagctactttctgctttccctattctttcgtattcgttcgcatttatacatttacaaccgcaaattttaggggtatatttaggggtatgaaatccactttatacccttaaatcttttttttagggggaacgtacccctaaaaacacgttaaagctaggtagaacgtatggcaagacctgctaaagagcttcataaaaccacaatacaaaatgcaaaacctgccgaaactgattataagatgatggacggaaagggactttttctattggtgaaaaaaaatggttccaaaatatggcggtttaggtatgttcgtccaaatacaggcaagcagactgatttaagtttaggcgagctaaaaaacctatcactagcacaagcaagagcattacgagatgaataccgcttgcttatttccaaagggattgacccacaaattcaccgtaaagaacaagagcaagctaaacagctacaacaagaaaacagtttttttaatgtttgcgaacgttggtttagagatatttaccctttaaaagcccacaatgaagaaacgaggcggaagaattgggagcggttagaaaggcacgttttccctatcattggcaatttaccgctggaagaaatcaaacctcgattgttggtggggctgtattctcaaattggggcaagtaatacgctagataaattacaccgcttgattaaagccacaatggatcacggcattaaattaggcattatcgaaagccacaattgcaacattgcaaaagatgattttgttgcaccgctggcaaaaaatcaccctgcgattatgcccgatgaattacccgagctattaacggcaatgaataacgcctatttaagcaagagaattaagcctaatacgttactagcttttaacctgactatgcttacaggcttaagacaaaccgagcttacaaggcttgaatggcggtttattgatgaaagtgagcagtattttattattccagccaagcgaatgaagcaatctaggaagatgaaagagcaaccgatagatcacattatcccgatttcgtcacaaatggcacggttactagccacaatccgccaaagatacggttacagccgttatattttcccgagtacagaaagcaacagcggaaccattggcaaggacaccgtagcaaaagcattaagagaaaacggctacgagggcaagcaagacgcacacggtatcagatcgatatttagaacctatttaaccagtataggcgttcccgtggtggttgctgagcttgctctagctcaccattcaataggtaaagagaaaacgcaagcagtctatgaccgctggcaatttatggaagaacgaaagcaagcattacaagccgttggcgattattgcgaacaatgcggaatgatgtttgaaattgagtaaataacagatttttggcggaatttaaccgcttgtagatgagattaaaacaatatggcaaaaacacaacattactataattctctacctgaatgttcaatcgttgattatgagcttatcccatacacggaaggggctttattgtggtgtggtgtaaaatttaatgatttatcagatgaagtaaaattgacgtcaagaatatcacaaagcatttacaagcacccatatattccttgtttagagaaaaaaactagaatgctaaataaggcaataaatgagggtaaattaagagttgttagagaacacggagagggtggggaaattcttactgactatctaggcaatataagaaaggacaataacggaaaccctatgattgatcacgttgcttatgatagacgttatttttggattaaagatttaaaagcctttatttctgaacattacccaaatgatcgccctaaaactattttccacgatgaagaactaaagccgattgttgatttagttgaatatgaaagaatgagtaaagaatatcaaaaattcttaactgaaaataccaatctacaaactaagttaaatgagctaagaacactactagagagcaaagaaagccaaaacagagatcaagacttggcactacaatcattatcaattcagttacagcaagccaaatcatcacaacaagacgctgaagaaagattagaaaaagggagagaactttatcggaaattacaagcagactataacagacttaaaataaatcctgaaacgaatttaaacctagataattcactctacttgctaggagaagttttaagcatagtgaaatcaaaagtcaaacaatggacgcaatccgcaattatcgatgaaattctaacgcaacgacaagagaagcaaataatcggtttagaacagcgaaaaatagaagaatactttagtacagctaataaactttttaaagccaaataatcccatcaacgcccagcaaaagggcgttttttattccccaaaaccctttcaaatcaacctgttattttcgcaacgaaaaaatctttttcgcgtgcgatgaagtttttaccccaccaaaacacaatacgccccgaatacaaaaacaacaacgcaaaggagcgtaaaagatggaaacattaaacccaacccaaaccacccaccaaaaacaattgcttgatgttcaagaagtgaaagctatcacagggcattcagtcaccactatttacaaatacgtcaaggagggcattttcccacaacctaaaaaatgtggccgttccactcgttggagattggcggacattatggaatatgtaaacagctaaggcacattcacgaggcgaaatcttatgaaacaacctatctacccaacccgaaaagcgaaagccatcaccgcactactagaacaccctgacggcataagtgggcgagagattgattttcaatacttcatcaatagcggacgcaatgaggtgacggaattaccaagactacacaatatcgccattcacaaaaccgaaagaccaaaccaatacggaacaggtacttacacgatttaccgcttacccaatacaaaagaagccttgaaagctatcaccttgctaaatggtgagcgtgctaaatgtggtttaccaatgctgactgagtatgaaacacaacgctatttatcacagtttaagggggaagaatgcgagtaaataaaaacctgctcactgagcaacaggagcaaatcaacgaagcgattaaattattagaagcctgtatctacggggcagtattaggtagcgagggcgagccacttacacaaactgaaatcattgaagcagtgattgaaatgctgaaaggagaagatcggtactacgctgaagaggtagcaaatgaccgcagtaattaaatgcgtaattgccaaaatgaaccctcttgtaatggatatggcaattaagcactacattgaaacggctctaaaacgcctctattcacgtttaagagcttgtattcagatgatgaaccttacccattagatgaattgctaatcgtgttatctgagcgaatagaaacgctagcgagggaatttaaagcaatgccaagcgatacctattacttcagttatcgccactacggaagaagtttgatgcgttgtacaagatttcagttaaggagcaaaacaatgacaaataacgaacaagaaaaaacacttaaatatgacctatcaccccaagggattggcgagctaatgaaagcaccgattaaagcaacgttaagcagtttagattttccctatattcgcattgagcaacaacaagacgacaacggcaaaccgttttatatcggtattttgtggttagaaataaacgatcaaatcattattgaaatggcgggagctaccgcatttaaagaagctctagcgattattgcttatcaacaacaagccacccaaacaccgttactagttgatgatgaagtggcggacagtatcagatatttctacgagcattctcaatacggtgacggcgtaaatccattgattgaacactatacaggtaatgaaatcacgttggaaatgatggctaaggctaatcgcaaacaagtagatctgttctttatggaaaaacgcattaagggggagcaatgccaaccttagacagacccaaacaagaaaattttgctcagtattttgtagaaacaggaaacgcaagcgaagcctatcgcaaggcttataaagcggacggaatgaaacccgaaacaattcaccgcaaagcaaaagaactaatggataacggcaagattacggcaaggattgaggaactacaagctgaacacatagagcgacacaaactgacagtagatgatttactagatgagctagaggtagccagagaaaaggctttagaacgtgagcagttaagcgttgcagtatcagccacaatgggaaaagcaaagttactagggttagataagcaagttatcaaccatacaagctctgacggctcacttcgccctacggttattgagttggtagcaccaaatgaaagtacagcctaggggttttactcaaaaatgagaaaaacactagaacctgagaaaacctgagatttaaggggcaacagaacctcacaaaacctcacatttaaggaacaacccaatgaaaacagaactattaaacgcagtattcccaaaggtatttcacaaagaaaccgtatctatgactgatacgctaaaagtggcggaatactttggtaaacgacacgacaacctattacgaatgattaaaagcctaggttgctctgatgaatttaacgccctcaattttaaggcggttaaatatatcgacgaaaaaggcgaaaagcgtccaatgtacctaatgacccaagacggctttacgttgttagtgatgggctttacagggggcgaaaatgaaagcattcactaagctaaaaaacgccccaaatatgaaactgcaaaaacctaatgcggagaatgcttatattattatcggctctcaagcgtgggattttgccaaagctccaccagctgaacgcacacagggagagatagcacttgatgatgtgttaccacagggcgagaaatcgccccctattgtgcttactgctgaggttttggaaaacgttcatcaataccgcatagcacctaaaaaggcttatatcatcacgatacagcgagctaatcacggtgaagatgtaagcggtgagatcatggataaactttgcttaaaccttgctaacaacacacaggctaaaatcattcactacattgacgaagccgagcaacaccttgaagatttaagcggatatatcgaacgcattcgacaaggtgaagcaatggcggaaaacgtggcggaagtgaccgctagcgatgatgtgaatgctgacatagataaacataagccttatgtagaaaaacgcacaaaaaacggcgtagaggggctttatcgcattaccccgaaatatgacaaggatacaggcgaactgctatcagagcgtacagaatggctttctgatgtgatttctgtagtaggtatagggcaaagtgaagctgaacattatctcgtgctagagtggacgcctgagggcaaatcgcaaccagtcaaagaggcgttatccttgggggatttaggcgaacgggagggatggcgacagctcaaagcaaaagggctacgcttaactactcgcacctacctacgcaacgagctagcggactatttacaaagtagcggtaagcgtaccctatggcacatcaccaacgctacagggtggcataatggggcttatattttgccaaatggggaagtattaggcgaacctgaaacacccgtgctatttaatcgtcaatccgccaccgccagtggatacgacaccaaaggcacaatagagagctggaggcaagagatcgccgataacgtgcgagttaatccctctatgatgttaagtattgcttgcgctttatctgccccgataatgaacatcatagaggctgagagctttggagttcacttattcggtggctcaaccgcaggcaaaaccaccaccgctaacattgccagcagtctatacggacaccctgacaaaatccgtttatcgtggaacgcaaccgctttagggctaatgaatgaggcatcggcaagaaatgataactttatgccacttgatgaagttgggcaatcatcaacttataagagcgttgagcaaacctcttacgctttatttaatggcgtggggaaaatacagggagcgaaagacggtggtaatagagagcttcaacggtggcggattatggtattttctacgggggagctggatatagagggctatttatctatgggaggcattaagataaaagcagggcaattagtccgcttgctgaatgtgcctatcacaagggcgaaagtctatcattcattccctgacggcaaggcacacgccgaccacttgaattatgcgagcaagcaacactacggagccgttggcagggcgtggattgagtggctaacagtggcggacaatcagaaaacactgattagcgttcatagccaaataaaagccaagtggctagaccgcttgccaagtgacgcaagtccacaggttcaacgagtggccagccgtttcgctatccttgaaaccgctttacagctagcgagctttctcacagggtgggacacttccgccaacggtgaagccttactacactgcttcaatgaatggattaatatattcgggctacatagccaagaagagaaacaaatcattgagcaggtgaacggctggctattagcaaatgctgaggggcggtttatcgaatacccaaacaaccccgaacagcgagccatctcgaatatcgcaggctataaaatcattcctcaacgagataatgagatagagcacttttatctgtatccattagcctttgaggaagcgataaagggacacgcaaaggagcaggcttgtaaaatcctatcagataaaggaatgctatctaagggcgaaaatggctatagatacttagtaagaataccaagcaggatagatccgaaacgtacaagatgttatctcgttttcccacttgttgaaagtgatgaagcataaaaaccataacaaaccatatcattaagtgctttttgtggtctgtatgctacattgatgatttaagagctttccagagatggttagctctttttttatctttgcaaaaaaaattttttttcatgcgcgtagttttttagtagtccaattagtccaaaatacctattaaaaaataatatctttatttatcaatatattacataaaattcattggactaatttggggtcgttttggactaattttggggcattttggactaattttggggcattttggactactcaaaaaatgaacaataagagtattttgttagttttggactaattttggactacattggactactcgattagtccaaaaaaatgccacttaagtgtttgattttaaaggattggactaattggactaattggactactgttttttactaaatataaaaaaatttttttgaaacagtaaaagtggcggaggggtggcgttttggtttctgcggataatatccctttttatgctacacattttggcggaatttcggagcagtacgcacgatgcttggttaggttcgatcattactaataaataagataattataagataaagattgaatatatttatagagtatcttataattattctattgaaagggtaatcttaggggttataaaatggctgtgattagatgggcaagcagggcaagcaaacagataagaactattgatagccgataccttgaccgaattattgaaaaaatcgaagcgttacaacaatttccaaatgttcaagcagatattatcgaactgaaaggcgagcaaaacaaaggcaagtttagaatgagagtgggattttatagggtagtttttaaagtagtgaacaataaaccgattattatcgaaatccaagagattaagaagcgagacgagcggacttataactagagctataaaacacaggagcaagaaataatgagcaatttacaatatatcagagataacagcggtaagcctttatatgtgattttacctatggcggaatatgaaaagttagtagatgtagacgagtacggctttaggatagaggaggatgacgaagaatgggaaagcctaccctacgagcaaagcgataatgacgatgcgttaattcctcatgaggttgttatgataatgattaaacataacgtaaaccatttaggagcgtggcggatttatcgcaacctatcacagcaagaagtagcggacaaagtggggatttctcaaggggctatttctcaaatggaacgaagcgacagcaagccacagaaaaaaacgctagaacgcttctcaaaaatctatgattgcgatgttaagcagatgtactaaataataagccttacattttttgaatgtagggcttttttgtgggctttaagaattaggggctttatacaaaattattcataggaaatataattatatatttgctccaattaaaaaggtactcccgacggggtggggctttccacggggttacgggctcgtggttttcggcaatttttcggggttctagccatcatcatcttttgattaaaagtgaatagttatgcctagaatgatggcggtagatgttgaatttgctgatactggttttcttcagtctcttaaaattgcaaggcgtgttattttaagtaaatggattatcctaaaattaaatcatttcctcaattttgaggagatgacaccgaagcatagttatatcaccatagtaaaaagtgaactttcttcacctgatccgccaatttaaaaacaaccctatacaagtgataaacttcaaaatgctgtagtgtttagtcgctaaaaatgattaaataataatctatttataggcgtttttttattataggggtacgtttaggggtatgatttagggtttaaatataaaataaccttttatttcaatatgttacattgcttgaatgtatccgaccactgcatcatcttagactgcacaaaaaaaacaaatttctttactaattaaaatggagagatttgtatgccacagtctatcaaaccgtttattgttacagtaatgttcaaaggtggagtaacaaaatcaacgaatgttgcaaatataggtgctttctgtgctgatcacggtattaaaaccttaatgatcgacactgatgttcaacctaccctatcgtcttattatcatattgaagattctggaccttttggattgtatgaatttttcactcgtcctgatcttccattaaaggagattatttctcggaccgaattctctaacttggatttaatccaatctaacgatccactagataagctctctaccgatcttacaagtacacctggaggtatcctgaaatacaatcaatttgttaaaaaattgatggctatgatttaatcatcattgacactagaggtacacggggcattacggttgatatggcagtccttgctagcgatcttatcctttctccactaagaccagagttggtatctgctcgtgaatttatgtgtggtaccttaggtatatataaaaatctaaacatttttacagactactgtactcttatataaattcgtgcggttaacatttatgtaccttcatttagatctataaattatgcctgtaccatttaactctatttaattgctatatggtggtagtatttaagttatggggctgtcctagataactaacttaaactgcccttaaccaattgttttaaaatggaaatttgagattttaagttactgtgattaaaacgccattcgcattccttcaaaggctaaagggctaaaaggcttgataaaacatctaaagtgtcacacaatattatcaagcgaatatttgaactataaaaaagaatgacaaaaaaatttcatatagaagccatacagaagtgggaatcacaagagttcgagaatacctcttttgatatgagtcatcttaatgcacacgaactaatcattcatagtaaaaaaatggattataaactcgttgttacttacggattgcactgttttactaagaatgattcaccattttcactacctatattagtaaaggattcttctggagatactcgtcaatttgacgttgaaagatacttagcatctaaagagtggaagaatatattattttccgaagatattttaggacagttgagattttataaaagtgatcaaaaacggtatttcacgattcataaaatgaataattttactagagcgtgttgatcttttaagtacaaaaaacaaacgacatagaaatttggtataatttagttcgccaaaacctaaccatcccatacaaactatgtcgcttagaacgattttaacagataatctttggaaacgcctagcttatttactcgaccgtacaggacgtgtttataataaacctgaacatcgtaatacagtggaagggattttatatcgcattcgtacgggatgcccttggcgtgaatagcacaaaaattcatttagcggtagatagttgtggaaatcctattgattttgttctgacgggaggtgaagttcacgacagtaaagctgcgtctgagcttgtggaattgttacctgacagtgagaccattgttgcagacagaggttatgattgtgaagccttacgagtgcttattttgacaacaaaagcagttctggttatacctcgcagacgaaattcaaaggtgggtaatgatgatatagactggtgtttatatcgttatcgccatttagttgaaaatgcgtttgcttttttaaaacaataccgagccattgcgactcggtacgataagttagcaagaaattatgcggcatcgctagcaatgatttgttgtattcgctgggggaaattgttgtttggttaagatttaaactcaaaagatcaacagcccctaataaattatagaaacacaacatcaaaatttggagagattatttatgcctaaattacgttcggcgactagcacacaaggtcgcaatatggcaggggcacgtgcattatggcgtgcgacgggaatgaaagaaaacgattttggtaagccgattattgcggtggtgaactcatttacccaattcgtaccaggacacgttcatttgaaagatatggggcaacttgttgccgagcaaattgagaaagcaggtggcgtggcaaaagagtttaataccattgcggttgatgatgggattgcgatggggcacggcggtatgctctattctctgccgagccgtgatttaattgccgacagcgtagaatatatggttaatgctcactgtgccgatgcgatggtctgtatttcaaactgcgacaaaatcacaccgggaatgttaatggcagcgttacgtttgaacattccgacaattttcgtttctggtggcccgatggaagcagggaaaactaagctgtctgaccaaatcatcaaattagacttggttgatgcgatgatccaaggggcgaacccgaatgtgtctgatgaggtaagcgatcaaatcgaacgctccgcttgtcctacttgtggatcttgctcaggtatgtttaccgcaaactcaatgaactgtttaaccgaagcactgggtttaagtttaccgggcaacggctcttgccttgcaacccacgctgatcgcaaacagttattcttagatgccagtacgcaaattgttgagctgtgcaaaaaatattacgagcaagatgatttgtctgtattgcctcgttctattgcaaccaaagcagcgttcgataatgcaatgagtttagatattgcaatgggcggttcaaccaatacggttttacatttacttgccgcagcacaagaagcggaagtggatttcacgatggcggatatcgatcgcctttctcgccaagtgccttgcttaagtaaagttgcaccgaacacgcaaaaataccatatggaagatgtacaccgtgcaggtgggattatggcgattttaggcgagctagatcgtgcaggcttattgaacaatcaaactcgcaccgtgttaggcttaagccttgcggaacaaattgccaagtacgacattatgctgaccaaagatgaagcggtacataaattcttccgtgcaggtcctgcaggtattcgcaccaccaaagccttctcgcaagatacccgttgggatacggttgatgatgaccgtcaaaacggttgtattcgcagcaaagagtttgcgtacatccaagatggtggtttagcgatgttgtcgggcaatatcgccttagacggctgtatcgtgaaaaccgcaggggtagatgaggcgatcttaaaattcaaaggcgaagccattgtgtttgaaagccaagaagatgctgttgcagggattttaggcggaaaagtgcgagcaggacacgttgtggttatccgctacgaaggcccgaaaggcgggccgggtatgcaagagatgctttatccaaccagctatttaaaatccatgggcttaggcaaggcttgtgccttattaacagacggtcgtttctctggcggtacatcaggcttatctatcggacactgctcaccagaagcagccgcaggcggtttaatcggtttagtgaaagacggcgataccattgaaattgatattccaaaccgtaaaatcgaactggttgtgcctgaagctgagcttgcccaacgccgagcagaacaagatgcgaaaggctggaaaccggcaaaccgtcagcgtgaagtctcttttgcactaaaagtgtatgggcattttgctacttcggcggataaaggtgcggtaagagataaaacgaagatttaattaaaatacaagcggtgggatcttttttataaaatctcaccgcttctctctacaatctctcccctactgatacgaagaagtaaaagtcgtcaccgcttgcttccaacacttcaacatgcaactcaccactatatcctgtcgggtttaaatctgaaatttcaaaagcaccagcagggacatttaattgacggataatatgcccattctggctaatagttactcttgcattactatgggcaatccctctgacagttggagcgtatcctctcaaggaagttggcaacatgcgatcatcacttgccagacgcacgccacgtagccctatcgcctcaacgacagccccatctgtggtaaaatctcctaccgtaagctcgcttcgcaaaggcacaatgggacgttttacataggtcgcaatacgatgataggaactctctcctgaactatcccaacttttcgcaccaacatgccgaaaagcccagtcccccaaatttattcccccattcaaagcaagatagtgctgtttataagaggtattgccataatgttgatagctattcaaatcataattaagaaaagcaacaggtactcccgtttgccataaatgtggagaaatatagcctctaggacgttgtacaacataaatttgcggaatttcaagatgaagcctagacaccgtataatcaaatctgaattttccccattgttaaaaagctactataaaactcagcttcaacccctttattcaaaacagagttaacatcatttgcaacaacagtagggcttaagcctaacagcacagtgagcattgccagccgaaaggaacaggttttattattattttcttcattttgacaccatctctttatttcatcatgaggaactaacgcaacactgcttccccttttctgttccgccaaaatcattaattgcttcccaattcactcgactaccactaactttcccttttaatatcaaagttttactagaaaatggtgcaaccatttcgctattaggcaaataagcatttcccaacttaacagattgataggtaataaaataaggtgtctgattatcgacaacgacccccttcgctgtcttaagccattgcactgactgataaacatcataagggctaagagagagcagggcgatagaaaaacttaatacgagaacgaatagcaaattgcagataattagtccctaaatcctccgctttaggtttaggcggaacatctaatacattcaaataaaataacgtttcacgatcttgaggcaaattttctttccctgtaaaaaccactcgcaacgtttgtcctgcgttgggctcgatgcgcacaatgggaggtgttactaaaaatggaacctgaatactatttggacggctgttaatatccccacgatctaaccaagattggactaacgcaggatctgagctactgttttgcaactgaacattgacactcttttgctcctcaggaaaaattactctagtaccaataatcaccacatttgccgtcgcaaatgtcatatatctgctctataacacttaaaaacatataaacaaaccgcgtttgatacatcacatttaaaagttaaaaatgaaatgtatccaagcgagtattctcccccccccccgccaaacgtaaagaaaaatgtcaaaaatgtgaagtatgccacattaaaaattcaaaatatgtaaaatttagatcaaaaatagagcttttaagataaataaattgacaaatcataagattaagtaaaaagataaaataaaatgtaatacaacacatcaagtcgcctacaaaacataaatcaaactgacattatattaaaaacgaattccgattattgatagagcaataatgttggcttaagacaataaaatatagacatcttccttgtgaaaattcccctttttacctacaatatcgccctttatttattgaacaaaaactatgtcgcaaattaaattgattgtcgggcttgctaaccctggtgcaaaatatgaagaaactcgtcacaatgcaggcgaatggctagtgaacgagcttgctcgtgtgtttaatgtcaccttaaaagaggaagcgaaatacttcggcaaagtcgctaaaattaacacgccacaaggcgaagttcgtttgcttgtgccaaccacgtttatgaatttaagtggtaaagcggtcggttcgttagcgaatttttaccgcattaagcctgaagagattttagtcgctcacgatgaattggatctcctcccaggtgttgccaaaatcaagcaaggtggcggacacggtggacacaacggtttaaaagacattattgcagcccttggtaatagcaataatttctaccgtgtacgtatcggaattggtcacccagggcataaagacttagtggcaagttatgtgttaggcaaaccttcgccgtcggatcagcctttaattaacgctgcagttgatgaagccagccgttgtgtggaactgctgttcaaagaagggattgttaaagcgactaatcgtttgaatggttttaaagcgtaaaattgattgaataacttttttgtgtgtaaacacagttgctacataataggaaaataaaatgggatttaagtgtggtattgtcggtttaccaaatgtgggtaaatcaactctttttaatgcattaaccaaagcaggtatcgaagcggcaaactatccgttttgtactattgaaccaaatacaggcgttgtacctatgccggacccacgtttagatgcgttagcggaaatcgttaagccagaacgtgttttaccaacgacaatggaatttgtggatattgcaggcttagtggctggggcaagtaaaggtgaaggtttaggtaataaattcttagcgaacattcgtgaaaccgatgcgattggtcacgttgttcgttgttttgagaacgatgatattgtacacgttgctggcaaaatcaatccgcttgatgatattgaagtgatcaatacggaattagctttagcggatttagatagctgtgaacgtgctattcaacgtttacaaaaacgtgccaaaggcggcgacaaagacgctaaatttgagctttccattatggaaaaaatcctaccgaccttagaaaatggcggtatgatccgttctgttgagttggataaagatgaactgcacgccatcaaaggttataacttcttaaccttaaagccaaccatgtacattgctaacgtgaatgaagacggctttgaaaataacccttatttagatcaagtgcgtgaaattgcggcaaaagaaaatgcggtagtcgtgcctgtttgtgctgcgattgaagcggaaattgctgaacttgacgatgatgaaaaaattgagttcttacaagatttaggcattgaagaaccaggtctaaaccgtgtaatccgtgcaggttataagctattgaatttacaaacttactttaccgcaggcgtgaaagaagtgcgtgcttggacggtgtctattggtgcaacggcaccaaaagcagctgcggttattcataccgactttgagcgtggctttatccgtgcggaagtgattgcctatgaagattttattcaattcaaaggtgagaacggcgcgaaagaagcaggtaaatggcgtttagaaggtaaagagtatatcgttcaggatggcgatgtaatgcatttccgttttaatgtttagtctacttattcatcttttgagtagattagttttcaaaaatatgtaacaaaaattttttgcaaatctcaccgctttcctttacaatcgccagactttttggggctgatcttggattcgacgggattagcgaagtccaaggtgcacgtcgaggtgcggtaggcctcgtaaacaaaccgcaaaaaatagtcgcaaacgacgaacaatacgctttagcagcttaataacctgctcatagccttatcgcctcagcttccgctcgtaagacgaggagttcgataagtcacccaaaacgagatcgtgtggacgccgccgtttgaggatcgaaacactaaattaaatcaaactagcttattctttgcgtgtctgtccgctgggggtaagcgaaattaaagactagactaaacgtgtagtgctgaagatggagtaatttcggacgggggttcaaatccccccagctccaccaaatcgacataaaccaacgtaaacgaacgtaacaagaagccttgaaaatcaacctttcaaggcttttttgtttctctcaatgtaactcgacgtaaacggaaataatagacttttagtaggatcactctgacatatatcaaaagccgtcctactaaggtgacagttatggctagaactacaaaaccacttacaaacacagaaatagcaaacgccaaacccaaagataaaaaatatcctttaactgatggcggaggcttgtttttacttgtaaagccaaatggggcgaaattatggcgttttaattactataaaccatacacaaaaaatagaactgaaataggcttagggagttatcctgatgtaaacttggcaagagcaagggaaattagggaagaatatagatctttgctttctcaaaatatagacccacacactcaccgtcaagccatagagcaagccaaacagacagaaatctataacacctttgagaatgtagcgtgggcgtggtacgaatggcgacaaacacgggctaatttctcgcagggctacgctagagatgtaaaaagtctaattgagcgaatactattgccagcttttggtaaataccctattacgcaaatctctgctccaatggctttaaaagccttcaaacctttgcaagaaaagggcacgttggaaacgttaaagcgtgctattcaaaagatgaatgaaataatgacgttcgcattgcatagggaaattatccaacacaaccctttaatcaatatttcaaaagaatttgatagccccactgtagagcattttaagacgatcaaacccgaagatctgagcgagtttttatttacgttgaatacgtctcaaattcagctacagacacgctatttaattttgtggcagttgcttactatgacacgcccgaatgaagcggctactgcaaaatatgaagatatagatgaaaaagaaaaggtatggacgatttacatcaataaggggattaaacaagatgacaaaggacgagagcataaaatcacattatcccgacaagctctagccttgttacgagagattaagaaattcagtggcggtaaggtttatttattctctagccataagaacccacaaacccacacgaacacgcaaaccgccaatgcggctataaagcgtatggggtataaagggaagttagtagctcacggtttacgcagtatcgcaaacacatacctgaatgaaaaaggttataaccctgagctgatcgaagtggctctatcacatataaaccaagaccgaattagaatggcatacaatcgagcggactacatcaaacaacgctttgaaatattgcaagcgtgggcggattttatagatgagtgttctcaaggggcattaccccagtatcatttaaagaaagtagcctgatgatgtttaagcctagttttacagctaggcttttttattacttttttctgcaaaacaaatgttattgcttagtctaataaacaaccttgaaactgtttaaaaaatcagtaaaataactctctaatcataaacgggcgtaaacgattgtaacaaataccacaggataaagcataatgttcaacgaattaaaaacagcacaagcaggggcatacttgctacataaagcaggcggaacaatgcatcacataaaattgatgaaattgctttatttatctgatcgtttaagttggttagaaagagatcattctattacaggtgatgaatattactctttaccttatggacctgtgctatctaagaccttaaatcttattcgtggggaaaccttaaaccatacaaaaacagcgtgggaagagtggattagcgataaggaaaatcatcaagtaagcattgcaaaaatagtagatgaaaaagatgagtatttctggggcgagctttctcttagtgatacggatattttagacagtgtttttgagaaatacggacattttgataggttcgcattagtggagcttacgcataatcccgacattgtgcctgaatgggaagatcctaaaggtggagcaaagaaaatcacccttgaaaagctattacagcatttaggcaagagcaaagaacaaatcaaagcaatctttgaggaacaagccgaaatgcaacaaatcaacagactttttaagggaacgatatgacagtaggggaccctatcccaaattctgtgtaaacacccatttcaacttaatggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatgtcagccggataatcaaaaaatgtggcaatatttgcccagttatcttcccagcctttcgccacaagcgggtattttgcctgccatttttgcgaaagtgcggtcagattttcgcgagcctgtgcttccgtcggggcctgataaacctgctttaaatctgcggtgacggctttgtaatctttccacgaaacgaatttcaagctgttacgcactaaatgcacaatgcaaagctgaatcttcgttttagataaccaagatggtcggtcagttcatcatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctctattccaaagatcttagagtttatctttgaactcgtttctttaaattttcccaatccaaaaccattgccgtatattgaataatccaacccacacacaaggcaaaaaacaatgtgctaacgccgactgttccgcctaagataaaaccaagcacacatacagtcacttcgattgttgtgcggacgatcccgactttccagccgtatttctggcacattccgaccattaatccatctcttggtccggcacctaaatggcacgaaaggtagaaagttgtgctaatgccaaacagtaaaatagcccctatcattagaataaagcgtgataataggctttctggagcaggtacatattgtacggttaaatcaataaagagagcgatccaaaaaatattgagtagtgtgcctaatccgaaacgtagttgaagtgggatccagagtagcagtacgataacgctgataatggcaaccactgtgccgatagacaagcccgtttgtaatgctaccccttgtgagaagactgtccacgggctagagcctaaatttgccagtactaatagcccttcaccaattcccattagaatggttgccactgagattacgcagagtgaactgggtttaagttgccattgatgttttgccgtccaaggcatttcaggaataggcgattttctactcatagcgtaaggcttccgccggctctatttttgatgctcgataagcaggataaagagtacaagccaaagagagcagaatagatgaacatacgatgatgatcacctgttccattgcaatttctgtcggtaacattagccctgttgggttgatgaaacgaataagatcacctaagtaagcggttgctagaaccccggatattccgccaataaacgccccaataataccaacaatagccccttgtgctacgaagatttgcgtgacctgtcctttggttaatccttgggtttgtaaaatcgcaatttcaccttgtttatcaaccaccattaaacttaatgatgtcactatattagaaattgcgacaacgataatcaggctaattaatagccccatcatatttttttccattctcaccgcttggaaaaattcccctttttgctctcgccagtcgttcactagccatttatccgcaggaaatgccgaaggtaattccgtgactaaaaaaggatcggttaaaaacaaacgaacaccttggctcttaccttcttcaatacgcaataaacgcccaatatccgccaaatttgcaaataaggtataagcactcgcttcattattcgaataataaatatctgaaacggtaaaaagacgctgaacaggcactcgaccaaatggggtatattgactattttccgtgatcatcaaacggattttatctcccacattcagatccaactgattggctaaccttgaaccgatcaatacattaaaatcgcctgcaggtaagcgttcagctaaatcgcttacttccgttaataacggatcatcgctatttttctcaacgccaattaattgccctgcatttatgccatgctgactttgaatcatcacatttgcacggctaattgggacagatttttccacataagcaggtaaatttaactgctgttctttgctccaagcttcatctatgggtgaaataatcgcatggggtaaggtagaaagcagattgcgtttctgcatattttctaagccattcatcacagaaagaacgataacaagtgccatcacgcctaatacaatgcctagacttgcaaggtttgtgactaatcgaccaaaacggtcgccacttttagaacgccaatagcgaaaggcaataaataaaggagttgttaagttcataaaaaattaatacgagtagaaattggtaaaattctaccaaaatctacccgcttgtcttagagatttctgttatatcaacaaaaaattagttaataacaccgcaagccattcttgctccgccaccgccaagtggtgctgggtggtctgaatggttatcgccacctgcgtggatcatcaatgaacgacctttcacttcttctaactttttcaaacgtggtgcaagaactggattagtcgcattaccctcgtgatcaaccgctaatgcaggtaaatcacctaaatgcgcttcatcagaccaaggataaccgtgctttttcgtctctttaggatcccagtgaccgcctgcacctaagccagcgactaatttgccatctttctcttttggttcacagcttggtttctcgtgaatatggaaaccgtgtaagccgtgtgacaatcctttcagatttggggtaaaaactaaaccgtaaggcgattcggtaatcgtcaccgttcccacatctttgttgccattttgtaaatcaagttgttgaactttcacttcaatttgggtagctgaatttgctatcgctgaagttgaaaatccgaaaagtgctgttaaagcaagggttaaaactgtttttttcataggaactcctaagttaattacaaattatttgcctgttttgacaaattcttcaatattctgagccactttattgactaagattgtcacggctgaatcactcgcccacgcaacgtgtggcgtaatcaataaattcggtaaacgttttgccgcttgaatgagcggattatcaatcgctggcggttctttgactaacacatctaatgccgctcccgcaattttgccattttctagggcatctagtaaggcggtttcatctaccaaaggaccacgtcccgtattaattaaataagcggtcggtttcattaatgccaaggtctctgcattaatcaggttttgggtcgtttcagttaatggacaatgtaaagtgacaatatccgcctgttttaacacctcttcaaaaggggtatagccatcacgaatagtcgttgcacctttatgttctgcataaagcactttcatgccgactaactctgctaaacgcccgacgtccgtccccaaacagcctttgccgaacacgccaagagtggagccacgcacatcggtaatcggataatcgacatagcagaactgcccacaagttgcccaacggtcgctggtgacttgatcacggtggtagctcattaaactatgttttaatgaaaaaatcatccctaaaacgtgttctggcactgtcacactggaatagcccgttacatttttcaccgcaatgcctagttcttttgctgcaacgagatcaacattatttgtccctgtcgccgtaattgcaataagcttcagtttcggcaacctcgctaataactctcgtccgaataacactttgctggtaatcacaatatccgcatcttttgctcgctcgtaggtttcttcagcagaagtgcgatcgtattcaatccaattatgcggaaaaggcggacgtggaatgttgtgagtggcaggaatgcctgtgcggtcaagaaaaacgatattcaacatattagttccttgtttggaaagagaaagtaagggtgaatatacaacaagcggtgcgttttaacaagaaatttacgaaacgaatggaatatacagtttgaaaagcgaaaatgtaggacacacgcagtgtgtcccttgtatattaaaattatagtaaactagcaacataaaccataacgttatccacagcttgggtgtccctagagctaaaactcgttctgtagcgtaggcgtggataacttcatcagcaaaaccgaacagttgaaatataaacccgaatacaaggcaggttaccgatgaacgctccgatttattgtggtattgatgttgctaaacgcaatttcgtgattggtttttcccatcagaaaaagaccaaaaccgaaaccaataacgctaaaggtattcaacataccttggactatttaagccagtttaatgtggctctgataacgcttgaagcaacgggtggattagaaattcccgtggcaaaagcccttgctcgagcaggttatcgtgtatttattgctaatccactgaaagccagtgagtttgcaaaatctcaaacgagagccaaaaccgatgcaaaagatgcggttaatctcgctttctatgggctcacttgtgagcttaaaggcgaagtagagcatcagttgtatgttccgctttctgagcaagaagaacagctggaagcccttgtggttcgccgtcgtcagcttgtggatatgcgagtagcagagctaaatcgtttgcaacaaagccacgaaacccagttggacaatatccaacaacacattgaaatgcttgataaattaatcgccgaacttgataaagatatcgacgaccaaagtaagcattttagtgataaagctgaccttatctcagacatcaaaggcgttggcaaaaattgcgtcgccgtgatgatgtcaagcctgccggaattaggcaagctaagcagcaaaagaattgcctcactcgttggcgttattccgcatccacaggaaagcggtcaatggaaaggaaaatccttttgctatggtggtcgagcgattgttcgtaatgccttatatatggcagcactatcggcaattcgctttgaacctgtttttaaagccttttacacccgattggttgcaaaaggcaaagcgaagaaagtcgctattatggcgtgtatgcgtaaactgctaaccattatgaatgcgttggttagacgcaatgaaaaatgggacgctacacgctacttatccacagaatctgtgggtcaaaattgaataacttttttgtgtgtaaacacagttgctactattatgaagaaaggttatagcttttcaacaagttccaccgcatagccaatatagcttgcaggggtcatctgttttaagcgatctttctctgcttgtggcaatgccaatccatcaataaattgacgtatcgcttcgccatctacacgtttaccacgggttagctctttgagtttttcatacggtttttcaataccataacgacgcatcaccgtttgaattggctcggctaacacttcccagttttgatccaattcatctcgcagatgttgttcattaacttctaatttactgatcccttttagcgtagaagcataagcaatcaacgcataacccaaacctacacctaagttacgcaatacggttgagtcggttaaatcacgttgccaacgagaaatcggtaatttttgccctaaatggttcattactgcattggctaaccccaagttgccttctgagttttcaaagtcaattggattaactttatgtggcattgttgaagagccaatttcacctgcaatcgtacgttgtttaaagtgatttaacgcaatatagccccacatatcacggtcaaaatcaatcacaatcgtattaaagcgagcgacacaatcaaaaaattccgcaatgtaatcgtgcggttcaatttgagtggtgtatgggttccaagttacccctaaagattgaataaactcttggctaaaggtgtgccaatcaacttcagggtaagcggatagatgagcattataatttccaaccgcaccgttaattttcgccaaaatctctaagttttctaattgcttatattgacgttttaaacgatacgccacattcgccatctctttaccaatcgtagttgggctggcaggctgaccgtgtgtgcgagaaagtaacggaatatctttgtaacggtgagccaattccacaacggcatcaatcacttttttccactcaggcaacaaaacttcttctcgtgctgtcttgagcatcaaggcgtgagaagtattgttaatgtcttcagaagtacaagcaaagtgaataaattcattgattttttgcagttcaggcaaggcttcacatttctcttttaagaaatactcaacggctttgacatcgtggtttgtggtacgctcaatcgttttaatacgctcagcatcttcaatagaaaaatgttcgacaatctgatttaagtaaccgtttgcgtttttagataaaactgaaacttcgttgatttgtgcgtgagaagccagtttttgtaaccaacgaacttctacggtaacacgaaatttaagtaagccaaattcactgaaaatagggcgaagtgcagtcgctttatcttgataacgaccatcaataggggataacgctgttaaagcggtcagttccattcaggtttctccgtacataaataaaaatcaacctgagaaatgtagcattttttgcgaggaatttcattagtttgttgtggttttatcaattttatatcgtattttgatagctttaacatatagcaaaatagtaaaaagtataatttctagccatcatagtgttttactctcttggtaaaactcattagaattaatcgtttttttctatcttcctaaggatcatctatgcatttccgaaaatcccctttagcgttagctatcttattatgtttatccccaattacagttacagtgactaatgccaatgctgaaacttatattgttactggtgaaaataacaatgtgcgcggcgaacaattccaacgtttacttaaccaagccaaagatggcgatacaattcgcttagacggagatactcaattattgcgtggaagtggttttttcaatgttgataaacaagtaacaattgatggacaaggaaatcgcttacaccttgaaggttataatttgtccttaggacaagatgttactttttcgaatgtaaatttatccttaaaacctagtcgagatttaaacaatatttttagttctggatttaaaatggataatttggaagcgaaaccaacctatattgtgacaaatggcaataaattgacattagataatgtgacaacgaatgttgatagcgaaccttcagatactcgcccaattatttggctcgggaatgctgatgctactaaaagcaataatggacataatacccttattgttacttcaaattcagcagaaactaaattatattcggtaatcattagcgataatacggaaaatagttctgatgactctcctgtaaacatacaattaggggaacatgttggattagttgatgcaatatatttagctggagtaaataatgatcaagcacataatagagctattcattttactagttcatcaaattctgtaactaaaatttatacgggagaagctacaaatgtttctgttacgttaaataacatcaatcctgaaactgctatcactttacaagatgttaaagatttaacattaaataatagccgtattactttggataagaatttatctgtttcagaaaccttaactctgaataatcaatccgcaatcactacagtggcgagtaaagatgcttttggtgacatcgctaagactagtttgatgttaaataatatccataccaatggtaataatagtaatatcactatcgttcgggacaatgctcttttgattaatggtaatattactggtgaattgactattaatacagaagataaagataataacgttagtcttcctaatggcagcactttagtaggagaaaatggcagctatgttgtgaagctaaaaacagaagtaactcaacctgtatcagaaaatacagcgactaacagcagtaatactgatgtaccccctgctaaacctacggatagcacaccagcaacaacaggtgaacaggctggttcgtcagatacaacatcgccaacagatacagctcaaacagacgatcaagcggaggcttctagctctgacactgcaacatctacaccaacacaaccaacagtcgtaacaactccgacaacggaagctccaacaagtgaacaagcgacaacgtcgagtacatctacaaaccacaataaaatcacaatcaccacagcagagcaggaaacacagcgagcgattgcggaaagtcgttatgccaccgttgtatctaactttgcattaaattctatccgaaacagactagaacacagccgttcaagtaatgcttatccgtatttaactgcaacggtaaacggcatgatcccgacggtttctgagccaggtaggttatgggttaattcaagctctgatcgaataacgcaggatctatataaattcaacaattttggattacaagtaggttatgataaatcctcggcgttggataatggcacagctcgttttggcttcgctttagatgttgaaaaaggcaaggctaactttgctcaattctctgaaacatataaaacccaaacatacggtatggcgttatatggtgcttacgaaacagaagagcgacattattttgatgttgcagtgagaatggcaaaagcatctagtgaactaaaatccaatgcttcgcagacatatcatcacaatctctattctgcatcactggcttatagtaaaggttttgaattgagtaaccgctgggaaatcgaaccatatacgcagttattctatactcacctaagttctacgaactatattagaaatggcttgaatgtaacggctgacgaaatcaatagcttagtaggtagcgttgggactaaggcagaatatcaactcaatcaaattttgaatttctatactaaagtcgcaatgcatagagaatttaacgctacacaagatattaatatcattcgtagtgccacagacagagttcaacataatatcaatcatcgtggaacttggacaacgttaggattaggtatgaaagctcgtctaggcaataatactcatttatatcttgatgtagataaattatttggtaatggatataaacaaagttatcaaataaatttaggattagattggaaattttaatttcagttagatcaataagttaaaagcagtgggatttccactgcgtttttaatattatagtagacatgagttgaatagaagtggcttacatcctaatgaacacaccccacatctacatcggcacgggcggttatagcgatacggatttagtcggtacgctctatccgtttggaacggacaaagcggattttttgtcggtttacagccagcattacgacaccgttgagatcaatagtacctttcacgccacgattggctataaggctgtgcaaggtatattaaaaaaggcggaagggcggttaaaattttcggtgaaactgcatcaagattttagccataaacgtaccgctaccgccgagcaagcgcaggcatttttggctgcgttacaacctctgtgtgatagccattgtttagccaatttatttgtgcaattcccgaccagttttgaacgtcagcacgccaatcgttactatctggcggagctggtgtcgtggtttagtgattatccccttgccattgagtttcgccacgccagttggcatacgcagtcggtgcgggattattttcacggcaaggaaaatttgatttggtgtaacgtggattatccgcagaatatcggtttgcctgcctttcaattttatgccaaccaacgcaccgcttacctacgattacacggtcgcaatccccactggtcgaaagcccaatcggcacaagaacgccacgattattgttatagcgaaaccgaattacaacaactggcaacattgttaaatcagcgaaaagcggagtttgatcagctttatctctattttcaaaacacaaccaatagccattcgttctacaatatcgaaagtctgaaaggctatttggcgagctatggatttaaagcaaaagagacacctgagtttttgagtggacagcagagtttgttttaataagagaaatccgtggttatttattagtaatattctacctgtttttcagctatacaaagaagtggagacaaaagtattggagagaattagagaacatgattaaaactaatacttttgcctactgtgccgatttctatagaaaataaaaagacctctgtggttttactaccaaagaggtcctttgaagattttaaattactgttggcaaacaccacaagttgcagctgatgagaacatccaaactaatttctcttgctctttgatgtagtcgctcatttgtgacgctgtaccttcatcttctgcagcatttgctaacgctaaaatttcacgttgttgtttaagtaaagtttggaatccttctaaagtacctgttaagcagtgttgtgctgaacttgcaccgatgtcttctttaacaagtgaaacttgtaagtattggctaaatgcgttatctggcgtataacctaaggttaagatacgttctgcaatttcatctactttaactactaagtcgtcgtagatttcttcaaattttgcgtgtaattcaaagaaacttacacctttgatattccagtgataaccacgcacattggtgtaaaacacttggtagcttgctaataagccatttaactcttttgctaatttctcagcagacaccttgtctaaaccgatagagtttaccatttttttctcctatataatgtgattcgcgaggcggattatagcctaaaaaaataattgaataaatgaatataatttattcatataatagaaaaaatcaatcagtttaatgaaaataatttctttttaaaacaattggataggaattatttttattgcttaaataaaagcactcttttttatttaaaaatgctctaacccatattgataaagtgcattttttttgtagccaaaagtgcctgcaacaattgcggccgcttttttcagtggtaattcttcacttaatagggagagtaatttaagtgcttgcggagaaaattcttcgcttttatctgcagttttcccttcaacgattaagacgatttcgcctttaatacgattgctatcttgttgtagccagtcgattaattgtgcaagcgggtcaccgtgaatagtttcccaagttttggttagctctcttgccattacaacatagcgttctccaccaaacacgctttgcatatccgttaagcagtctaaaatgcgatgggtggactcatagaaaatgagtgtgcgaggctctgtggctaattcgttaaatttgtcacaacgagctttactttttgctggtaggaacccttcaaaacaaaagcggtcagatgcgatacccgaactgcaaagtgcggtaattgcagcacaagcccctgggattggtacaatgttaatgccagcttgacggcaatggcgaacgagatggaaaccaggatcgctgattaatggcgtgccggcatcagaaattaaggcgatgttttgcccttgttgtaatttttcgacaagcacggtggcacgttgttgttcgttatggtcgtgcagtgcgaagaaaggtttttttataccataatggcttaacagaataccgctatggcgggtatcttctgctgcaataagatcgacggcagcaaaagtatttaaggctcgctgagtaatgtcctctaaatttccgattggggttgcaacaatatataatgtaccgatttgtttaggtgagtattcgtttttcatttgattttcgcttagttgataagtaagatctgcctaatattcacagactaacttaagtctagataatagccaaatttatggagcaataatatgccaactattttagtacaaagttatggctttcgccaaaaaatgaaaacgatctttattcctactgcccttgctttgttgttggcagcctgttcaggtaataaagtgactgaaacattaaaaaacgaggcttatggtaactctgaattttatatcaataaagccgaacagagccgcaatattgaggaacagcaaagttatcgtttgttagctgttcgcaagttaattgaagaaaataaggttgttgaagctcagaataccttttcagagattttggtagctaaactaaacgatgagcaaaaacttgaacatcgtcttttaattgctcaattagctgcattacaagggaacaattcagaggctcaaggtgtattgagagctttaccacaaacactattaagccaatctcaacgtctgcgtgtgtatcaaactcaagcccgtattgctgaaaatcaaaatgatgtcattgcggcagttaatgcaagagcattgatggatcgctatatgacggatactcaaagtcgccaagcgaataatgacaaaatttgggagatgttacgcaatgctaaccgtggtatgttagaaaaagcggtggcaggtcctggtgaaatcggattagctggttggttagccttagtggttgcttataatcaaaatatgtctaatccagcacaattgcctcaagtgatcgaaatgtggaaacagcaataccctaatcactcagccgtattgttgcttccaattgaattgcgaaatgtatcttctttccaacaaacccaattaaatggcgtggcattattattgcctttaagtggtgatgcaaaaattttaggggaaatcatcaagcgtggttttgacgatgctaagggcacaacaaccatgcaagttcaggtatttgatactgatagtgctcctattaatgatttattaatgcaggcgaagcaacaaggggctcaaactattatcggtccattgttaaaaccaagagtagatgaaatgctaaccagtcctgaaattagcaatatcaatgttcttgcactcaattctactccaaatgtaagagctgtcgccaaagtgtgctactacgggttatcgccagaagcagaagcacgttctgcggctgaacgtttcctgaaagatggcttacagcatgcggttgtagttgcacctaatggcgattttggcacacgttctgcagaagcctttgctcaacgttggcgtcagcttaccaatagggatacagacattcgttactacaatcaagcctttgaagtaacctcgcttttacaaggttcaggaattggacagggaagtggtttatatgcgttaggaacagcagagcaattatctgatttgaaacaaagtttagataactcaccgcttgctaatcagttcccaatttatacttcttcacgtagtaactcgccaaacaatgggcctgatttccgtttaacgatggagggagtgaaattcagtgaaattccacttttatctgatccttcatctagcgaatataaaaaagcagagcaaattgtagaaagcgatttttcaatgatgcgtttatatgcaatgggatctgacacttggtctattgcgaataaattcaacgaattccgtcaaattccaggttacaaagttcacggattaacgggcgtactgagtgcaggcccaaattgtaatattgagcgtgaaatgaactggctacaatatcgtggcggttctattgttgatgcaaactaatatgcgttcacaaggtgcatattttgaacagcaagccaaaattttcttagaaaagaatggcttgcggtttattgcccaaaatcagcagttcaaatgtggcgaactggatttaattatgcaagagggcgataccttgatttttgtcgaagttcgccaacgcaaaaatgcctattttggctctgcggtagaaagtattgattttcgcaagcagcagaaatggcaaaaagcagcaaatttatggcttgcacaacgaaatcaatctttagatacggcaaattgtcgttttgatgttgtggcatttgaaggtgattgttcacctatttggatcaaaaattttttaggatagtatgttagaaaaaattcaagatcgctttagtgaaagtattcaaattcagattgccgcagcggaattactgccaaaagtattaaacgaagcggctaatcgtatcgtagcttgtttgttgcgaggcaataaagtgatcgtttgtggctatggacgctcttatgccaatgcacaattgctggtgagtaatttgttacaccgatatgatcttgtaagacctagcttatcggcacatttactgcaatttgatggaatgctcgtgggctgtttaaaccaagatcaagatctcaatgaaatctttcgtaaacagctacaagtgattgcaaaagagggagatctgtttattgcattttctccactaggcaacgaacaagcggtcttaaatgcgatacattgtgcaaataacgaaaatttggaaatttttgcgtttaccagtagtctaaatgatcatacaaaaggactgcttgataataccgatctggatattgagatgccatcaattaatgaaatgcgaattattgaaggacatcaattttgcgtgaatttaatctgtgagctggtggataatctgctgtttccaactacatcacactaacattgaaataggagaggactatgttaaaactcgttaaacgcattacccttgcaagcctatttggcttaacatttctatcattacaaggttgtttagccactgctgttgtaggtggagcagcggtcgcaacgaaggttgcaacggatccaagaacggcaggtcgtcagttagatgatgaaacactggaagaaaaagtggcttataatctgaataaagatcaacaacttaacagcgaagctcgtatcaatgtcgtttcttataacggcaaagtcctgctgataggtcaagtccctaatgatttttccaaagactcggcgagtagtatcgctacaggggtagaaggcgtatctacggtttataacgaagttcgtatcggccctaaaattggggttgcacaaattagcaaagatagctggattaccacaaaaattaaatcaaaactctttgtgaacggctctgttaaagcaacagatgtcaaggtgattactgaaaatggtgaagtattcttaatgggtaatttatcaagtagtcaagcagatgccgctgccaatgttgctcgtcacgtcgatggtgtcgtcaaagtcgttaaagtgtttacctacatacaataagggcattgataataaacattaagcatattggtattcttggagccgatatgcttttttgtaaacggaattttgtcaattactttaaagaacattgactttaattgctcattcattaattatcacaagccatttttcagtcaatacactccctttaattttttaagaaattgtatttttaaaccagaagaaagcgaatgcgtgagataaaaaatttggttgaagtaaaaaaactcacctttaaacgaggtgagcgagttatttacgacaacctaaatctacaagtccaaaaaggcaaaatcacagcgattatggggccatcagggatcggcaagaccaccttgctacgccttatcggtgggcaaattttacctgaaagcggcgaaattctctttgatggacaagatgtttgccaagcaaacaataaaacgttatatcaacttcgtcagagaatgggaatgttgtttcaatctggtgcgttatttaccgatctctcaacttttgacaacgttgctttccctattcgtgaacacaccaacttgcccgaagaattaatccgtaaattagttttaatgaaacttgaagccgtagggctacgaggggcggcacagctaatgccttcggaattatctggcggtatggctcgccgtgcggcattagcacgagcgattgccctagatcccgatcttattatgtatgatgaaccttttacagggcaagatccgatcagtatgggcgttatcgttgaattaatcaaaaagctcaatcaagcactcaatctaacctcaatcgtcgtttcacacgatgtgaatgaagtgctaagtattgccgattacgcctatattattgcgaataaacgcattattgccgaaggaacacctgaaagcttattagcaagtcaagatccacaagtggttcaattcttatcaggaacagccgatggaccagtgcagttccactatcctgctcaaaattatacggaggagctatttcaatgatggagtttatatcctcaataggtgcttccgttattcaggcgattagagcaatgggacgagccacctttatgttgtggggggctttagtcggtaagccagaatttcgtaaacatacccctttatttatcaaacagttacacgttttgggcgtacaatccttactgattattatgctatcaggcttatttatcggaatggtgctaggtttacaaggatatgtcgtcttagtcgatttctcggcagaaaccagcttaggacagctcgtttctctctcgctcttgcgtgaactcggccctgtcgtcaccgcattgctctttgctgggcgagctggctctgccctcactgcagaaattggcttgatgaaagcaacagaacagctctcaagtttagaaatgatggcagtcgatccgctacgccgtgttatcgcaccacgtttttgggcgggcattattgcaatgccgattttagtggtgatttttactgctatcggtatttggggtggctcacttgttggcgtagattggaaaggggtcgatgcaggtagcttttggtcagtaatgcaaagtaccgtaacaatgagcgatctgcttaatggcttcattaaaagtatcgtctttgcctttgcagtggtctggatagctctatttaatggctatgatgccctaccaacctcagaggggattagccaagcaacaacaagaaccgtcgttcacgcttcactggttattttagggcttgattttattttaacggcaataatgttcggcggttaaacaagcaaaggtattattgtaaaatagcagacaaaatacaccgcttgttagtgtatttgaataggaaaaattatgcgtcaatcaattaaatatgaattttgggtaggcttatttgtacttcttggattaggagctttagtctttttgggcttacgagttgctaacgtacaaggcttctcttcggaaaaaagctactcactctatgcaacttttgataacattggcggactaaaagtccgtgcgccaattaaagttggcggtgtagtaattggacgagtatctgatattcaactcgatcctaaaacctataccccgaaagtcacccttgctattaatgaagaatttaatcaaattcctgatacaagttctctttctattaaaacagcaggcttactgggcgagcagtacattgcactgaatgtgggctttgtccttgaaggcgaaacagcaatgctcaaagagggggatagctttgctgataccaactcagcaatggtactggaagatttaatcggtcagttcttatatggtgataagaaatctgacaaaacagaagacaccgctgaacctaaagcggaataattgctcacttttaaaatcacattgtggagttttatgatgatcaaaacccttaaaaacctttttattgcaggctttgttgcaatttctgcattcgtttcaaactcggctttggcttctactagcccttatgtcctaatgcaacaaacggcagataaactttttggtgatatcaaagcaaatcaaagcaaaattaagaaagatccaaactatttacgcactatcgttcgtaatgatcttatgccacatattcacgttaaatatgccggtcaattagtcttaggtaaaaatttagcgtcagcgactgatgttcagcgtgaagcttttttcactgcatttggtcaatttattgagcaatcttacgcgcaagtattaacacaatacagcgatcaacaagttcaaattgaaagtgaaaaaccgctagacaacaaatctatcgtcagtattcgcgtcaatgttctacaatcaggcaacgccaagccaatcaaattagatttcaaatggcgtaaaaatagcaaaacaggtgaatggcaagcctacgatatggcagccgaaggtgtgagtatggtcgcaaccaaacaaaacgaatggagcggtattttacgccaacaaggaattgacgctttaacagctcaggttgcacaatctgcaaaacaacctatcacattaaaataattcgggtatgcaaacaaaaaatccattacaatggcatattcagcaaaacaatgaaagtctgatggttcaactatctggcgagcttacccgtgacacgttgcttccactttggaagcaacgtgcttcttttttatctcccaaaagctcgcagcacatttattgggatttaaaaggtctcactagcattgattcctcaggctttaccttactggctgaactacttcacctctatcaacaaaaaataaaaactgtttatttaatgttccgcaagcggtacacagccttgcagagctatttgatttagcaggctggtttaaaaaatttctattttgtgagaagaaataacaatggaacccaaacaaattgaagaaatcctaaaaaacgccttagaacttgatgaagtttatgtacaaggtgaaaattcccattatggtgttatcgcagtaagcgacagctttgccacaatgtctaaagtaaaacaacaacagatgatctatggtcctttaactgaattttttgcaaccaatgcaatccacgcattaacaatcaaaacattcactaaagaacaatggaaaagagagcgtttgctcaatatgccaagctaatcacatcatctaaaggaattaaaatggaaaaatttcgtgttcacggtcctttcactttaagcggaactgttgatatttcaggtgccaaaaatgcagcattaccgattttatttgcggctattttagcggaagaacccgttattcttacgaacgtccctgatttgaaagatgttgaaaccacattcaaaattctacgtaaactaggtgttgtcgttgaacgtgcggaaaataacgcagtacatattgatgccagcaaaattgaccattatgttgcaccttatgagcttgtcaaaacaatgcgagcttcaatttgggcgttagcccccctagttgctcgtttccatcaaggtcaagtttcattaccaggtggctgtaccatcggtgctagacctgtcgatatgcatattgcaggcttagaaaaaatgggagcgatcatcacccttgatgaaggctacgttaaagcagaagtaaatggtcgcttaataggagggcgtattctgatggataaagttagcgttggtgcaacattatctgtgatgatggcggcaaccgttgcaaaaggcacaaccactattgaaaataccgctcgtgaacctgaaattgttgataccgccattttcctcaacaaaatgggagcaaaaattacaggggcaggcacagacaccattaccattgagggcgtagagcgtttaggtggctgtgaacaccacattgtcccagatcgtatcgaaacaggtacattccttgttgctgccgcaatctctggcggacgaattacttgtcgaggcacgaaagcggatacattagatgccgtgattgaaaaattgcgcgaagcaggaatgcaagttgacgtgaccgaaaacagcattaccctcgactctctaggtatgcgaccaaaagcagtcaatatccgcacaatgcctcacccaggcttcccaacggatatgcaggcccagtttacactattaaatgtcgttgcaaatggcaccagcaaaattaccgaaacgatctttgaaaaccgctttatgcacattccagagctaatccgtatgggagcaaaagcagaaattgaaggtaacacagcgatctgtcacggtgtcgaaaacctttcaggtgcagaagtaatggcaacagacctacgagcttctatcagtttggttctggcaggttgtattgcaaacggtcaaactattgttgatcgtatttaccatatcgaccgtggatatgaacatattgaagataaactacaaaaattaggtgctagaattgaaagatttaatgcaccatttgaagaataatttttcatataaaacaacataattgctaaaaagtgacctaagccttatattacaaggctttagcccctattttaaaacatgagcaaaaaatctcccattttgtcaaagtttgaaaattaaggaaacatagtatacaaaataatatccaatgttatttggtaataaatgttataaaatttttatcttaaaaaaataaattagatccaattaaaatttggacttattacacatctggaatacaaacctatcaacagcttgctgttaaatctcgttgttcagtcagaactattcaaagatatcaaggttattttccttataaacatcgcaatgtagggggatgccagtctaaaacattagatggggcgatattttatctatgaaaaacatcctgaattaaatatagaaaagataacaaataggttagatggattatttaaagaactgaaacagaaattatcagttcataatggattaacgaaaaagcataagattatgtttataaaggattttttaaataaaaagagttggtaataattagggaaaataattaaaaccaacacttttgtctatgatcaatatactagcacctgaatattgacttaacttccgacaatagaagggactaacttttattattcatcaaacaagactagttcttttttttctatttctggtggattatcacataaccaatttgctaaacgggcataatccgcaagcgataagttttccgctcgtgcattcaaatctacccctaatgcctctaactgctctacactaaacagcgtagcaagtgcgttgcgtaatgttttacgacgttgattaaaggcttgtgtggtcacacgatttagccagtaaatatctttcactgggtacggcagtgttttatatggtactaaccgcactactgcagaatccactttcggagcaggtttgaatgccgttggtggcacttccaacacgggcattacttgacaataatattgcgccataatggttaaacgcccgtaggctttgctatttggtgcagcacataaacgcttaaccacctctttttgcaacataaagtgcatatcttgaattaagtcgtggaatttaaagagatggaacatcaacggagttgaaatgttgtaaggcaagttaccaaacactttgacagctttgccattcaaggctaggctatcaaaataggcacggaaatcaaaacgcaacgcatcttgttcaatcacagttaatttttgatgtaaaaacgggtgatggcgtaaacgttctgcaagatcacggtctaattcgaccacagtaagatgatctactagatctgccactggctcagttaatgcccccaagcctggaccaatttccaataaaaattgatcttgctgcggattaattgccgcaacaatattatgaataacgttttggtcgtgtaaaaagttttgaccaaagcgtttacgagcggtatgccctaaatgtttttttgaatttgaactcattggataccttaacaagcggttatgttcccactgatttttataaatttaataaagtaaagaacctcgcatatgcgaggctcccttaattattagataaattaaaaatattttatatctaatttacttctcaatacttttatccaatcttttgatgccacttgcacttgtttatcaataagctgctcgtaagctttctgtaaataagcatcttccgtacgatctcctctgcgagtatcagtaacttttagtatatgccaaccaaattgtgatttaaaaggagatgaaatcacatcaattttacttttacttgcaatgttagcaaaagttgaatcataggcatctagaaaattaaaaccgagatctcccccatcaataccagatatataatctacagagttaattttcgctgcttcttcaaatgttattttaccagatttaatgtcagcggtaattgatagtaattttgccttagcttgcatatcatttaagattggcgtcgttttaatcaatatgtgactaatacgatattctgtagcggaaactgtttcaagtgtaccgtttgtttttgctttatctagcatatccttcgctaaagattgaacatctttcggatctacttgaatagaatttccaatactttgttgccgaacttgttccattaaaagctgatgagcaagttgttgacgatactgactaagactaatgccctgataatccaaagcatcaagtagttggccatatgttataccattttgagcagcaacatcttccatcatctgatcaacataagcatagtctacttttataccagattctttaatcgcacgttgcacaacgaaatcatcaataatagtctccaaagccgctttacgattagcttccgtattcgcttttttacccaaagcctgttttacttgactcttcataatgggataaccatctactgttgcaacgactctctcttccgcattagctgaagaaaatgcaaataaagcaaaacctgcgataaataatgattttacttgtgtaaacttcattttaatttcctatgaatattgtagataaaaaattcctgctacttagaaggctattctagcaaaaggttcacaaagattgaattttcttaatcacatttgtggtcgaacaaccgttttcaaagttgagtacacgaacctcgccaccatttgcccaaacttcttggctacctgcaatctcttctggcttataatcgccgccttttaccaataaatcaggcaaaatttccccaattaaacgttgtggcgtatcttcaccaaatggcacaacccaatcgactgaagcaagccctgctaacaccgccatacgcgcgtctaaatcgttaatcggacgactttctccttttaagcgttttacggattcatcagtattcaccgcaacaatcaaacgatcacctagcttacgtgcattttcaaggtaagaaacgtgtcctgggtgaagaatatcaaagcaaccgttggtcatcacgattttttcaccacgtgtttttgattgttgaataattgctttcaactctgcttcagataccactccaaaacctgtttcagaacgttgatgtattgcctgttctagttcacttgggctaacagtcgaagtacccaattttccaacaacaacacccgctgctgcattcgctaaatagcacgcttcttctaaaggacgaccatctgcaatcgcagttgctaacacactaatcaccgtatcgccagcccctgtgacatcataaacttccttcgcttgggtcggtaaatggaatggatcttgatttgggcgaagtaaggtcatccctttttctgaacgagtaatcagcaatgccgataaatcaaaatcggctatcatttttaagcctttagccacgatttcatcttcatcactgcaatgtcctgcaaccgcttcaaattcagacatatttggcgtaagcagtgttgccccacgataacgctcaaaatccgttcctttcggatcaattaacacaggcacatttgcttgacgtgcaatttgaatcatttgttgaacggcatcaagcgtacccttgccataatctgacaggatcaacgcaccgtaagcggtaatttctgctgctaattttgcaagtaacgcttggcaatctaaattatgaaaaccttcttcaaaatctaaacgtaataattgctgatggcgagaaagaatgcgtaatttggtgatcgttgggtgagaatctaccgcaacacattgattttgaatactatgttcgcttaacagtttatccaatgctcgccctgcatcatcattacccactaaaccgtgtaaagtgacaggtacgttcaggctcgcaatattcattgccacgtttgccgcaccgccagccctatcttctctctcttgaactttgacaacaggcacgggagcttcaggcgaaatacggttagtggcaccaaaccaatagcgatctaacatcacatcgccaagcaccaatacttttgcattgttaaattgcggggaatattgcatcatcatagcttcaatctcttatcttttacttttcttaataaatttcatcaagcgtttacgtttacgcaactggcttggggtcaatttattcttcttacctgcaaatgggttgtttccttcttggaacaacacacggatcggcgaaccaataattttcaaactcttacggaaatagttagacaaataacgcttataagagtcaggcaatttctcgatttgattaccgtgaatcacaatgatcggcggattataaccacctgggtgagcatattttaatttcacacggcggccatttactaacggtggctgatgatcatccgttgctaattgcaaaattcgagttagcattgatgtcgtcattttcttcgtcgcacattgataggcttcttggattgagctaaataagttgcccacgccactaccgtgcagagcagaaataaaatgcactcgtgaaaaatcaataaaatctaaacggcgatcaagctctgatttcacattgtctttaatatcctgcgataaaccgtcccatttattgacaacgatcaccaacgacttcccagcatttagaataaagcccaatagcgataaatcttgatcagacacaccatcacgagcatcaattgtcagtaaaaccacattcgcatcttggatcgcctgtaaggttttaatcaccgagaatttctccaccgctaaatgcaccttaccacgcttacgcacccctgcggtatcaatgatggtatattgctgaccatcacgttccatagggatatagatcgaatcacgcgtcgttcccggcatatcgtaaaccactacacgttcttcacctaaaatacggttagtcagtgtcgatttacccacatttgggcggcctacaatggcaatcttaatgtttttatcgtcggcttcttcctgatcctcttccaatgcttcatctaataacgccgtatcttcttcgttatcaaagtcaaaatcgctatcccattcgtcttgttcatcatctgcaacattttcatcggaatcgaccgcttgtgcttctaatttttccgcaaggggagctaaaacctgttcgataagctgtgtcacaccacgcccttgtgccgcagcgattggctctacttcgcctaaacctaactgataaaattccgcaatatgagagtctgcatcaataccgtccgttttatttgcaaccaccacggttgttttatcacgctgacgcaaatattgtgcaatacctacgtccgcaggcaataacccagcacgagcatcaactaaaaataacactacgtctgcttcttcaatcgctaacagcgactgttctgccattttctcttcaacaccttcttcagtgccatcaataccgcccgtgtcaatcacaataaaatagtgtccagctatatttgcgtgaccatatttacggtcacgggttaagccagggaaatctgccactaacgcatcacgggtgcgagttaagcggttaaataacgtagattttcctacgttaggtctgcccacaagggcaacaacaggagtcatattacaacctcatttaaaatcggtttacgaacatcttacgcaaaatacgtacattatatcgtactttaaaagaaaacggagaaaataataaagagtgggtgatgaagagagttagggcaaaatagtaccctaacaaagagttattcttctaatttcaatgctttagaaaaactttgcagacctttaacattgctattttttgccattgcttgcaaggcttgtgttggaatgtgtaataactgatttgtcagtttataactcaattcatttagtactttttcgcaatcctgcccttgttgcaaggcacttaacgctttttcaagtaaatctaaacgaatctcttcagcattttggcgataatgtttaattaaattggttgattgttgctgtttcaaccaaacaaagaaatcttttgcctcctcaataacaatttctttcgcttgctctgctgcctgttgacgttgagctatattctgctgaatgatattttgtaaatcatctacactataagcataaatactatctagttctcccgctttttcatcaatatcacgaggaacagcaatatcaatcaataacattgggtcaaaacggcgttgtttctgtgcttgttcaaccatttctttagtaatcaaaatatctggactacctgttgaacaaatcactacatctgcttgatttaaaccgatttgcaatgcacttaacgaaagaatttgcattggaatatctagtttcaccgctaacatttctgctcgaatatgagttcggttagcaatcataatattttttgccccgtgattaattaaatggcgagccactagttctatagtttcaccagcaccaactaataaaaaacggagttttttaaaatcatcaaaaatttggcgagctaagccacaagcagcatacgcaacggataccgcactactaccgatttcagtttcagagcggactcgctttgctgtagcaaaggttttctgaaatagccgagaaagattggtggaaacgccacttccttgagaatgataaaattcttcactctcttggtatgcctgtttcacttgccctagaatttgtggttctcctaaaattaacgagtctaaaccacaagcgacactcattaaatgacgagcagcttcaaggttttgcttgaaataataggcctcgcttaattcctctttatctaattgatgaatttcagcaaaccaattaaaacactgttcacgccaagcaatattatcagggtgttcttcttgagggggaacttcaggctgatggaaataaagctcagtacgattacaagtagataaaattacaacactttctgctaggctttgatcacgaatttgctcaaatgcacgctgacgtttgtcttctacaaacgctactttttctcgcaagctcactgatgccgttttatgattgatacctaatgctaaaattgtcattgttacccacagaataaaaaaggtggaaaccacccaaaaagacggagcattttaatcaatccatgcggttggtgcaaataattgtcttaataggtttgatttataacaagtgaataacattttatgacgtataaagtggtaagatttttttaaaattttgtaaatctaaaaaatccccacgattttggagtgatttcagttataatacttcaaagcagttttacattgtcaaattctgtcaagaaccctttcagttaagcgttatggaggacttatggttgcgattcgccattcacaccggctcgatccgaacaattttgagttggctagttggagtgctgggctacagatgtctcctattacctttgaacaattactgattgcgtggcgatatgcacaggaaaaaatcgatattgaacaaaatcacttgatgtggtttggggttgaattggtcgaaattttgcatagtttgaatatggacgatgatagccttgtcgctgccttacttttccctcttgtgaagcaaaacatcattgatttagtgcagattaaagagcattttgataatgatgtgaaaaatctcgtcaaaggtgtgttggagatggataacgttcgccaacttaatgccagtcacgcttccgatcttcaaattgataatattcgtcgtatgcttttagcaatggtggacgatttccgttgtgttgtgattaaacttgcagagcgaattgtctatttgcgtgataccgaacgcttaagcgaagaagatctggtattagccgcaaaagaatgttctcatatttatgcaccgctcgctaatcgtctaggaattgggcagttaaaatgggagctggaagattactgcttcagagccttacaccctcaggaatatcgtcaaattgcgaaatatgatttaggtgaacgccgtttagatcgggaacaatatattgcaaattttgtcgaggatctgaccgcctgtctgcaagatgagttagagagtgtgcaaatttatggtcgccctaaacatatttatagtatctggaaaaaaatgcagaaaaaacatctgcgttttgagcagttgtttgatgtgcgtgcggttcgggtgattgtgccgaatttgcaagattgttataccgctcttggcattgtacatacacattacaaacatttgcctgaacattttgatgattatattgctaatcctaaacctaatggctatcagtctatccatacggttgttttgggcgaaggtaataaaaccattgaagtgcaaattcgtacgcaaaaaatgcacgatgatgcagaattgggcgttgcggcacactggaaatataaagaaggtgcaacggctgggcgttcaggctatgaagaaaaaatcgtttggctacgcaagttgctggattggcagaaagatattgccgattcgggcgatgtggtggctgaaatgcgttctcaagtctttgatgatcgtgtttatgtctttactccgaaaggggaagtggttgatttaccgaaaaatgccacccctcttgattttgcttattcaatccacagcgaaattggtcaccgttgtatcggtgctaaaattgcaggacgaattgtgccgttcacctatattttacaaatgggtgatcaagttgagattattacgcagaaaaacccaaacccaagccgagattggttaattccaagtcaaggctttgtgaatacagcaagagctagatctaaaattgttgcttggtttaaaaagctagatcgtgataaaaatattccgcttggtaaagagatgttagaagcggagatggctaaattcaactttagccaaaaacagattgaggatttagccctacctcgctacaacttaaaacaaattgatgatctttatgcaggcattggtggcggtgatatacgcttacatcaattaatgcactatttgcagagtaagctcatcaaaaccactgccgagcaagccgatgaagcgatcttaaaacaggtggcaaataaatctcaacagcaacagaaaaaccgtagtggttttgttgtagttgagggagttggaaatctaatgcaccacattgcccgttgttgtcagcctattccaggtgacgagatcgttggttatatcacacaggggcgaggtatttctatacaccgttctgattgcgaacagctctttgatttacgcagtagtagccctgaacgagtggtggaagcagaatggggtgagagctatgcttcaggcaaatttagtttgaccattcgggtgattgcaaatgatcgcaatggcttattgcgtgatgttagcggtattatggcaaatgaaaaagtaaatgtgttaggcgtatcaagtcgcaccgatccaaaacgtttaattgcaacaatggatgttcaaattgagctaaataatgtggaattgttggataagttactaaaacgtattctacaaattgatgatgtgattgatgcgaaaaggttgtcaaactagcataataacttaaaagtagggacgccacgcttggcgtccattttatgttacattacataaaacgatattatggacgccaagcgtggcgtctctactttgatataatagagatcaaaaactgaataaaatataaaataatgtaggatatttatgcaaaaattagtcattttaggttcaacaggctctatcggaaaaagcaccctttctgtggtcgataataaccctgagcagtatcaagttttcgctttagttggcggaaaaaatgtcgaattaattaccgaacaatgccaacaatatcaaccgcgtttcgtggcattagatgatgaacaggcagctgcaaaattaaaagaaaatctcaccgctttaggattgaaaatcgaagttctcgcagggcaaaaagcgatttgcgaactggcttcacaccctgaggtggatatggtaatggcggcaattgtgggcgcggcaggcttattaccgacgctctcagcggtgcaagcaggcaaaaaagtcttactggcaaataaagaatcattggtcacttgcggacaaatttttattgatgaagctagcaagtcaggtgctaaattgctccctgtcgatagtgaacataacgccatttttcaatcattgccgccagaagcacaagaaaaagtaggtttctgcccgcttgcagaactaggggtaagtaaaattattctcacggggtcaggcgggcctttccgtacaaaaccattgaatgaatttggtcaaatcaccccagctcaagctgttgcacaccctaattggtctatgggcagaaagatttctgtggactcagctacaatgatgaataaaggattggaatacattgaagctcgttggctctttaatgcctcagctgatgaaatggagatcatcattcacccacaatctatcattcactcaatggtacgttacattgacggtagcgtcattgcacaaatgggcaatcctgatatgcgaaccccgattgctcacacaatggcatatccaaaccgtatctacgctggcgttgctccattagatttctttaaattaaaagaactcacctttattgaacctgattttgctcgttaccctaacttaaaattggcgatagaggcttttgccgagggacaatatgctacaactgcaatgaatgcagcaaatgaaattgcagtagaggcatttttaaacgatcaaatccgttttacagatattgtcgaagttaatcgtcaagttgtcgaaaatattgcccctgttcaagttaaagaaattgccgatgttctacatattgataaattggcaagagaggtggcgaagcagcatattttacaattttaagagtattataggcaaaagtgttggttttaattatttcccctaattattaccaactctttttattcaaaaaacctttataaacataatgttatattttctcgttaatcctttatgaaccgataatttctgcctcaggtctttaaataatccttccaacctatttgttgtttttttctatatttaagtgagcatattcttcaaaggtgaataaatatttcatacagtattttaaactagcataagcccctcttacattatggtgtttataaggaaaatatcctttctcattgggatattcagaccgttcatttaaaaactctttatgttttaaataccattggtgtaatcttaaataaaattcatttttgaggctttcttttagccttttttacgaagtatgttcaatgcgagtttgtaatagaagtctttttctgttttgatgacacggtgataaacgacttttttagctcgtgtatccattaaaactaatacaccaaattcacgaccgaagaaggttacatctgcaataatatttatataagtttgttgtaatggaataaattcagctttagaggacttttcaatataacgttgaatagttctaatggaacagtgatatttttcggctaattgtttataggtttgttttcctattgtgtaatcagtccaaatatctattggatttaatttctttgtgaaagaaaaagttttatgacaggacgaacaaaagtatctctgaatattatttttctttccatacttttggatattgtgcttaaggcaaaaaggacagttttttgttgatatttcaaaaaaagtgggcttaaagccttgtactagaaggctttaagccactttttaccaacacttttgtctactatgccaaaataaacattagcaacaattttgtccacttggcatagtttttgacgaatcagcaactattttgactactatgccggttttcttcgtagattactgttttttagcccaatctaagaaacgtttttgtgtttctttgtctgcttgttggaaccagtattgaagttgttgttctgtgacattttctccttgcacaacaattttccccttattaactttactggtattatttgccattgttattggcatagttgataatgcaaatttttgtacagcagcaacaccttcaccaatattgtagtttgccaagttattgataatatttgaattaggcataaaaccttctccttttaggaaatcttgcttatatgttagcttttttcctgaaacagtttcaattttgaaactgggtgatttcttaaattgtgctatatcaaattcactatttaaactaggtgcaaggattttaatatcttcagtgcttccttcaaaagtgagaataataggttgagactcaaaaaaggcactatcagaaccagactgatagatactggatatttctactacaacttggtgtagattggtatcatttacctgtaaattagtatttcttcttactttttgtccatcaaaagcaagaaaagttacatttgaagaacccgtgattgtacctgcaaatgccgttgttccagcgataagagctgtcattgcaagggcaattttacctaatttcataacataatctcctaaaagggtataagggtaaaaaaactgctatatcctatgctaaatttgtgtaaatagaaagggcgaagtttcaatcattgtcgattttttattggaattatgataatttccccctgcttaacttataacgagaaaataaaatgagtgatgaacaacatagcgtaactacgcaagataataagtcctttttaaagtcgctatttggtggcttatttcaacaagagccaaaaaatcgtgaagatttggtcgaagtgatccgtgattctgctgagaatgagctaattgatacggatactaaagagatgattgagggggtaatggaaatttcctctctgcgagtgcgagatattatgatccctcgtccacaaattgtatttattgatgccgatcagccattagaggcttgtgttgatgtgattattgaatcggcacactctcgctttcctgtggtacgtggcggtaaagataccattgaaggtattttgctggcaaaagatctgctcaaatacctacgttccgattcggagccattcaatatggcagaaattctacgcccagccgtgattgtccctgaaagcaagcgggtagatcgtatgttaaaagagttccgttccgaacgttttcatatggctattgtagttgatgaatttggagcggtttcgggtttggtgaccattgaagatattcttgagcagattgttggggacattgaagatgaatttgatgaagaagaaatcgaacctattcgtcagctttctcaacacacctacgctgtgttagccttaacagatattgaacgttttaatcagcaatttgcaattgaatttgatgatgaagaagtggataccgtcggcggcttagtaatgcaagcctttgggtatttaccaaaacgaggcgaagaaatcgaattaggcggaatgatgtttaaagtcacctctgccgacagtcgtcgtttaatccaactgcgagtgactgtcagtgatgaacaattagcgttaatgcaacaagagaaacaagacgaatgagagctgtaaaaaaatcgtcatttttaaccgcttgtgcggtcgccttagtttcaagcggaataggaaccctagcttattcccctttcgactattggtttatcatcttcttatctgcaagcggtctgatttggcttgctacacacaacaataagaaaatcgccctatggggaacattcctctgggcagtaagctatttttgtattggggtaaactgggttcacgtgagtatgatccagtttggtggtgtacctgaaattgtcagctatattgccgtattactgctctctgcctacctagccctctattttggcttattcgcttatctggtacaacggtttaaactggctaatccttggctacttgcagtcatattcaccgcaactgaatatctgagaggtgttgtctttactggctttccatggctacaatttggttatagtcaaatcgacagcccattttcaggagttgtaccgattttaggggttgaaggcttaagcttttttgttatggtaatcagcggttatctggtagcgatctgccgtgatctcgcaaaaaaagcgactgttccgaccgcttcctgtgccgttgttgtcagcctgttagttcttgcctttggttcacaatttattcgttttgttgaaatcgatgaacaacaaccgccaacaacaatggcactggtacaaggtaatatcgagcagaaaatgaaatgggatccagcccattttaactacaccgtaagaacctatcagcaactgatattaccgttacttggtaaatatcaggtaatcgttttgcctgagtcggcaattcctgctgtagaagctcaaattgaacctttactacaacagttacaaaccgttggggctaaaacaggcagtgaaattattattggtacgctacaccaaactccaacagatatatttaacagtgccaccgtactgggcaatccgcagcaaccctactcgctcgaacaatcgcctcgttacaataaacatcaccttgtcccttttggcgaatatgttccctttggcaatttgctagattggatgagggaagtctttgttttacctataaatttatcgcaagggacatttatccagtcgccactacaagcggctaacagagcctttaatttagcgatttgctacgaaattatcttcaccgatcaagttcagcaaaatcaaaaagctcaccaagccgattatcttctcacgatttccaacgatgcgtggtttggcacgagtataggtccttggcaacattttcaaatggcaagaatgcgagctttagagctaggcaaaccgctaattcgtgcgacaaacacaggcattaccgcctttgtcgatgcctacggcaaagtcaccgcccaagctccacaatttgaagccaccgccttaactgccagcgtgcctgcaatgaaagggcaaacgctgtttgctcaatatggtaatagcttgctgtatgtactgtgtgtactgttattactattaggggcagtgatgagaaaagtgagagtaaatactttcaatttgtaaacattggtctaaattttaatcaatcaaactatttttatgaactttaaagaaatatcgcacactaacaagcgtgcattcaagaaaaataaaaacagcgtagaagttaggagaacgcaaaacgatgagtgagcaaagagccgatcaagaattggttgagcttgcacaaaatggtgataagaaagcgtttaatttactcgtcgtgcgttaccaaaatagagtagctgggttgcttactcgctatatcgcaagagacgatattccagatattgtgcaagaaacttttattaaagcctatcgttcattaaatgctttccgtggggagagtgctttttatacttggctttatcgaattgctgtaaatacggcaaaaaaccatttaaccgccttaggtagacgaccaccgaaagaagatattttagctgaagatgcagaagtttatgatggtggggtgcagttgcgtgaggctgatacaccagaaaatttggtgttgtctgaagaattaaaacgtgtcgtgtttgacacaattgaaaacctacctgatgagcttaaaacggcaataacgttgcgtgagcttgaagggctgagttatgaagaaattgcagaagcaatgcaatgtcctgtaggtacggttcgttcccgaatttttagagcaaggggagcgattgatgccaaaatcaatccgcttttgtagcagaattaaaatactttggagttatctatgcaacataaagaaacactttccgcctatatggacggacataaagaaagcggtgatttcgctgaaactttatgcaatagtgctgagttacaaaaaacgtgggcgaactaccatactattcgtagcgtgatgcgaggtgaagagcagattttgggtagtgatttctccgcaaaaatggctgcgttgctcgaaaatgaggagattgaggcggtggctgaagctcaacaaagtgagaaaccaagaggtatgttactcaaattgaaacgctgggcaacaccgttaatgcaggcggggattgcagcttctgtctgcttggtagccgtttggggtgtgaatatgatgaacagcagtgaggaagtggctcaagcggagcaacctgtattgcaaaccttgcctttctcaaattctgtacagcaagtaagctataatgcgccagccaaagatcagccgacagctgaacatttggagtatcagcaacgccgtattaatgtgctgttgcaaaatcacgagttacaacgtcgtactagtgcaggaaatgtgactttaacggaagatgagaaacaaaaagcacaaaactcttctattcaagtgccattacagccacaagcacaacctcaaaataatcagtaacttcttatcactctgggggcgttttaaacgcccttcagattattgacaaagtggcttgtagggtgggtcttgacccaccatatagccgtaacatattgattttattggtgggttaaaacccaccctacaatattcaatccatctaatatatggtttgtcagcagcctgaggggcgttttaaacgcccctccattttttatatacctatggaaaacgaaattgaacttaaaataatgctactgcctgaaaatattccggtgttaaagcagtggataaatgctcaacctatcttagaacaaggaaaagagctgttaggaaatacctattatgatagccccgatctcttttttgcgaacaacaaaatgggattacgggttcgtcatcaaaatcagcaatatgaattaacccttaaaatgaaaggcgaaattgtaggtggattgcatattcgccctgaatataatctagcattgcctgatgctcagccagattttaagcggttagtttctcactttaatttaccctttccgcaagcagatttattagacagtcaattacaaccaacttttagcaccgattttgtgcgagagaaatggttgattacaacgtcgacggctcaaattgaaattgctctcgatcaaggcaaagtgaaaaatccttttggggaagaagccatttgtgaagtggagtttgaattaaaacagggaatgctagcggatttaattgcatttttagacacattgcctaaacaagatggaatgtggtttagtagcttgagtaaagcccagcgaggctatttggtcggacagcctgagcagattgcaaaagagatcgataaacttaccgcttgtgatatagcacaattatcagaaaaagcccgttatcagttagagcaacagttggtggacttttggcgactaatgcaatcgccgaaattagccgaaaaattagcgacgctatatcctcagcaagcaatggaatattttacagggtgggagtacttcaagaggaatttggaaaagttgaatgtttggatttaaaaatggctatataattctaataatcttcctcttatagtaagtagtagagtaaataattggcatagtagacaaaaagtgttggttttaaaattatttttctaattaccgctaattttttgtctactatgccgattgttattgtttactgtatcaggtttatctattacatcgaaataaaccagggctgagtcaggaaataccatcaccagcccttttacattcattttttataacataggatattaactcctacgtataaagcagctatagttttggacctgctgcaattaatgctttaccttcatcgttggttgcatattgctcaaagtttttcacgaaacgacccgctagatcttccgctttcgcttgccattgagctttatctgcataggtatcacgagggtctaagatcgcaggatcaacaccaggtaatgcttttggaattgctaaattgaagattggtaatgaacccatttctgctttttcgatagaaccatctaaaatcgcatcaatgataccacgagtatctttaattgagatacgtttaccagtaccgttccaacctgtattcactaagtatgcttctgcacctgatgcttccatacgttttactaacacttctgcgtattgtgttgggtgtaatgataagaatgctttaccgaaacaggctgagaatgttggggttggctcagttacgccacgctctgtacctgctaatttcgctgtgaaaccagataagaagtagtatttggtttgctctggagttaatttagatactggtggtaatacgccgaatgcgtcagcagttaagaagattactttcgttgcgtgacctgcttttgatactggctcaacaatgttatcaatgtgataaattgggtaagaaacacgagtgttttctgtttttgaaccatctgcgaaatcgattgaaccatcttcacgaactacaacgttttctaataatgcgtcacgtttaatcgcacgatagatgtcaggctcgttttcttctgaaaggttaatagttttcgcatagcaaccaccttcgtagttgaatacgccatcgtcgtcccaaccgtgttcatcgtcaccgattaatttacgttttggatcggttgataatgtggttttacctgtacctgataaaccgaagaataccgctacatcgccatcttcacccacgtttgcagaacagtgcattgatgcaatgccttttaatggtaaccagtagttcatcaatgagaacaaaccttttttcatttcaccgccgtaccaagtaccgccgattaattggattttctcagtaatgttgaatgctacgaaattttcagaatttaagccttgctctttccagttcgggttagttacttttgaaccattcattaccacgaaatctggtgtgaagttcgctaattcagcctctgatggacggataaacatattttttacaaagtgtgcttgccacgcaacttctgttacaatacgcactgcaacacggctgtctttgttcgcaccgcagaatgcgtcaataacaaatagacgtttatttgataattggttggtaacaagttctttgatactttgccaagttgattggctcattggtttgttatcgtttttcacttcgtcgcttgtccaccaaacggtatctttggtattttcatctaatacgatgaatttatcttttggtgagcgacctgtgaaaatccctgtatcaacagcgaccgcacctgaagtcgttaaacgtcctttttcaaaaccttctaactcaggtttcatctcttcttcaaagagttgttcataacttgggttataaacaatctctttaacgtttgtaatgcctaaaagtgcaagttcttgttcaacacgatttaacataaattcacctcatatatgattaaagattaaaatttaaaaactggagagattatagagtaattatccaaaaaaaatgttacatacttcaaatttttgagaattgataaaaaatttttttgatctagattatattttttgtaattcggggtagaatagttcatcttttttattgaatggggtaaaagaatgcgagttttagttgtcgttttagcacttttattaggtggtttccagtatgcgttttggtttgggcaaaacggttggaatgaataccaacaagctaaacaagaagtctctcaactgaaagaaactaatcagaaactgaccgctcgtaatcaacttattcaagccgaaatcgaagatttaaaaacgggtatcaatgcccttgaagaacgagcaaggcttgatcgtgaaatggttaaaccagatgaaacgttttatcgcatcgtcccaagagagcaacgttaatgaatagcaagcgaaaaatcattgcgatcattcctgcttctggcgtaggtagccgaatgaatgtggctgtgcctaaacagtatttaaccttgctgggtaaaacgctgttggaacatacgctacaaccttttcttgaacaccctgcgatcagccaaattattgtggcggtatctaaagaggatcgccattatggcgatattgctctgcttaaatccgacaaaatccagattgtgcttgggggagaaacacgcgcaaattcggtttttaatgctctcaatgctatcacagatgaaaccgcttgggcattagtgcacgatgctgctcgcccttgccttaagcggtcagatttagacaaacttttgcagattgaagataatcaaggggcaattttagcaacccctgcaattgatacgatgaaacgggctaatggctcgcagattgctcatacggaagatcgttcaaccctatggcacgccttaacgccacagttctttccagcgaaattgctcaaagaggctttacaatcggcttttaagcaaggcttaaccatcactgacgaggcttctgcgatggaatttgcaggcttccacccgttattaattaatgggcgtagcgataaccttaaagtcactcgtcctgaagatttagctctcgcagaattttatctaacaagaggataataagatgattagaattggacacggttttgatgttcacgcttttggacaagatcgtccattaatgatttgcggcgttgccgttccctatcatacaggctttatcgcccacagtgacggtgatgttgctctacacgctttaagcgatgctctgattggtgctgctgctcttggggatattggtaagctctttcctgacacggatatgcaatacaaaaatgctgacagccgtaaattattgattgaagcctaccgccaagttcaagcaacgggttatgtggtagggaatgttgatgtgacaattatcgctcaagccccgaaaatgcgaccttatattgaccaaatgcgtcaagtgatcgccgacgatctcaactgcgatatttcttgcgtcaatgtaaaagccacaaccacagaaaaattaggttttaccggacgtggcgaaggcattgcttgtgaagcggtggcgttattaattaaaccagcattatgcagtagttacagaaatatttaatttctttcgtagcatcagtgttcaaaccatatttcataaagagagtatagtaatgctattcaaaacacctttgttacaaaaggctgctaataacattgaaaaattaaggtagagtttgatctacaattttttttcttttgatttgctttccattggttgatacaaaattgtggtaaactatcgccattttttagttacttaaaaatactatgccaacagtcaatcaatcctctcttgtgccttatagtgctgaacaaatgtatcgtctagtcaatgactatgaaaaatatccgcagtttttatcaggctgtgttggggcaacgaccttaagtttaggcgacaatgaactcaatgcagaattagtcattcaaaaattggggattagccaacattttagcacccataatacgatgataccaaatgaaaaaatcactatggaattattaaatgggccgttcaagtatttacatggagcttggacttttcagtcgtttgatgaacagagttgcaaaatcagcctaaatttagaatttgaattttcaagcccgatgattggtatagtgtttggcaaaattttcaatgaattaacgctcaaaatggtgaatgcgtttaaacagcgagcaaaagaggtgtatggtgtctgatacgcaaaaaatcgtggtggaagtgatttacgcttatcctgaaaaatatttttataagaaaatggaattagacaatccactttccattcaaaatgtgattttgcaatcgggcgtattgcaaaaacatacggaaattgacttacgagaaaataaagtgggtgtttttagtcgtcctgcgaaattaacggatatggtggaaaatggcgatcgcgttgagatctaccgcccgttaatcgccgatcctaaagagattagacgtaaacgagcggaagagcagaagaagtaacctataagggttatttcacaattttgaatttttgtgttgggaatattgtatcattaatttgtagatctaatgtatagtcgccaattggatccgtgttatcaaatttccaacaacgacgaatgaattcgttatttacacttttcatttggcttgtaatagtatgcattttcccatcttttgttgatactacattatcgccttgtccccccctcattgtagattttgctgggctattaaatatttcagtcgttttattttgagcagtaaaaggtacattaattacttcccagcataattgaatttttttattactgatagagtatgttgtgctatttagtgacttagggacttccccactaaagtcaattgtggtgagcaccatcatagggggctctggggtaatatctgctgttgcagcaaatcccattgtagatggtagaagcagactagttatagtaataagatattttttcatctatttttcctctgatttttgatgggtatcacgcagttgttgagcgacaatcgcaattgcttcgccgctgctgataccttgttgcataagttgttgaatttgttgaacggcttgttgttgctgttcgtgagttaaactcagtagtgtattatccatatagaaccatgataagtctaataaaatttagtaaagttccaactaaattgcgtaaaaagtgctttccactgttcgtcaagcggtgcttttatctcaattgtttgcaaggttttcgggtgaataaattgcaaactattggaatggagcataagtctatcacagcctgtgtttgctgttaatactcggttttgatgcaggtctccgtaattggtgtcgcccataattgggtggaacagatgttttaagtgacgacgaagctgatgtttcctgcctgttttggggtagagttgtaccagactataacgtgcggttgcaaattttcctgcagggtagggcatttcaacggtagcaatgtttcgataatcggtaatcgcttcttgtgcctctttttcttgggaaaatttatccgcaattttgtcgagttgcactttaagaggataatcaatccgcccttccccttgtagataacctcgaacaacggctaaatagcttttttgtatttgatgttgtttaaaaagctggcttatcgtccgtgccatttcgctatttaaggcaaaaagaagcacgccagaagtcggtcgatctaaacgatggatcagaaaaacgtgttgcccgatttgatctcgtaaagtttgcattgcaaaaactgtttcgtgtttatcaagccaacttcgatgaaccaacattcctgcaggtttgtttatcgcaataagttcatcatcttgatagataatctctaatttcattcgcttttcaacaaggtttcaagtttaacgaggggcgcgtttaaggcttggagataatctaaatctttcaaggcttcttctagataaggcgaaatagcaaaattgcgaggcaattcggcattggcttctaatagggcgtgcattcttggtaagaagatccattgtaaccattgggttgcagagagtgtgctaacacaaaaaggttcatcattggctaaggcttctgcggaaggcggagttgcttcccagagattatgtactcgcaaagcgatttcgagatcggttaggtgttgttttacttgggttttcattgttattttatatgattaagaattcattgattatgttctatctacactattgtgtatcgagatatttttccctgctgttgacttaacagctgctctgccccgtctttatctagatctgccaagatcatcataatcgccaatttcgcattattctcagctaagactaacgtggtttctgcaatttcacgggagcattcagtcgcttgcataacaatccgaatagcacgggcgacaagtttttgattgcttgcctgcacatcaaccatcaagttttgatagcatttgccgattaagatcatacttgccgtagtaagcatatttaacactaatttttgtgctgttcctgatttcattcggctcgaccctgtcaacacttctgccccaacgacggtatcaattacaatgtcggcaatttggctcattgcagaattagggttgctggcaatcgacactgtcgttgcaccaagctgtttagcgtatgctaacgcgcctaacacataaggcgttctgccgctggcagcaatgccgactaagacatctttttggctaaattcgaccgcttgcagatcttgtttacccgcttctttgttatcttccgctccttcgattgggtgtcgcaaggcacgctcgcccccagcaataatgcctttgaccatttcaggtgacaccccaaacgttggcggacattccgacgcatctagcacgccaagtcgtccgcttgtgccagcgccgatatagactagccgcccgccctgctgaaaggcttcgacaattttctcaacggcttgggcaatctgaggcaatactttttcgatcgccaatggtacttgtttatcttcattgttgatgatttgtacaatttcataggcagaaagtttatcaatctgcatactgtttggattacgctgttcggtaattaattgccctaaggtttttagaagatcttgttctgccattgttactctttttatatattgggaaaaattgcccctaaactgaccgcttgtgtcgcccctgtgacgctaggtaaattcgcaggcagattgtgtatcctttgatacgcaagccacgcaaatgctgccgcttccacataatcgacatctaagccgtattccgttgtagtggagacctgccaatcggttaaatgagtttgtaaccgttccattatcaatggatttttcgctccgccgccgcataccaataatacacaaggataatcctgcgggttttcaatttgccgtaaggcttgcactatgctttgtacggtaaattcaaccagcgttgcctgtacatcttcagcaggaagcggtttaatttgggttaatttatgttccaaccattccaagttaaacagctctcgccctgtgcttttcggcggtgacagttggaaaaagggttcgtctaacagcaatgcaagtaaagcggaatgaattttccctgtccttgcccattcgccgttcgcatcataccgcttgccgagatgtttttcgatccaaatatctaataaggtattgcccgccccgacatcatagccgatagtctgctggttaggattaagcacggaaatattgctgatcccgccgatatttagcacaacggttaggcgttcaggggaactaaacaccgcttgatgaaaggcaggaaccagcggcgcaccttgtccgccaaatgccatatcccgacggcgaaaatcgccaacagtagttatacctgttctagccgccaataaattcatatcgccaatttgcattgtaaaaggggactgcccttttggtgaatgccaaacggtttgcccgtgacagcccaccgccacaatatcatcagcattgagttgatgtttagctaaaaaacgctgaatactgtcagcatagagcaaggctaattggtgatcgagttcgcctaatgcttgtaggcttgtttccccttttttgactaactgcgacagggcaacacgaagtgtgtcgggcattggggtgaagtcggcagcaattaatttgggcgtttggctaaaatcgactaacgccaaatcaacgccatcaaggctcgtgccagacattacgccgaggtaattttgagaaaccataggtaattataaaaataaaatactgctttcagctcaataatagaggataaaaattcatgtatttatgtttgagttctgattagccaatagacgttaggcacgattattaaattgctatgagataatactatgttgttttgctctaatttccgtatcactgtgcagtggcgttatctagagcaatattgctcactaagcctttattatcaaagtaaacaaagatagttctttggataggagcttcatagcctttacgcaaaatgaacacataatcccaacgatcttgagcaaaggaatctcgtagcataggtgttccaagcagatattgaacctgctctttattcataccaacttgcagttgatcgattttttcttgctctaaatagttaccttgtggcacatcaatacgataaacgactttttttatcgtagagcaagcagtaacacctaaggcaagtaataatacagcaacaagcgatttcattttcatagcgataaccttcctcttaaaatttttggcgattataccgaaatcgccgataaaatgtcattatttattacgttctaattgatctcgtaaatttgcaggcaatcctttgattgtcaaagtatcatttagttcatcccaaataatacgttgggacaataattcagcgtcaaagctgattgtcaccccttttcctgaacctgagtatttggttaaggtttttaacgcattacgcacaggcggaatactttcttctaaaccgtactcttgttgttcagcaaagtcagcaaaatcaatctcttttaaagttggcattgaagccgataattcgctgattgcaatttcttccccactattgatttgccctttacagtactcaaacacctgttttttaaccgcttgagtttggttactatctaactcgccttgttcacaataatcactcaccgcttgaagcaacgtttgattttgcacttgcggatttaacccttcttcagcccctaaaaagtccataaagaagtcggcaactttacgcccaacacgccctttaataaaggtcaaatagcggttagattgtgcattgtgttttagttcagtaaggttgatacggcaagcaatatcatattgtgtaatatcgagatattccgtgcgtttcacttccagtttatcatcaaccaacatagacgcacggctatcaattaatgcaataaagagatattccgtcgctaaaaaggtataacggcaaaggataaaagttccgcctgaagcaaaaggatatttgactaattctgtcgctaacattttggcacaactgtggctaaaaggcagaaattcgctttcgccttctaacaagcggtttaattgttgtgcaaaaatggattccgattgaaatatgccataggctttcgctttattttgataggcttgatgtagttgcaacatcatctgttcaacttcagggctgatcgcaagcagatcttcgcgtaaaaccgtatgaagctcagcagtttcccctgcggtttgttgaagttggtgtaaaacaatttcggtaacgttaatgctcataaattattctcgattataggtaaaaagttaaagtcctttgattgtatcaaagagtagaattaaggttaatggcatattttccaatggaatagcaccataagattgataccaacgagaaatgtcttcatcttttgcttcaatgagaagcccaattccccagacttgttcggcaacgatggcacagcgtttgagagctttaaccaacagcattccgccaatgccttgtttttgatagcgaatatccactgcaagtcttgctaatgtaaagagcggaatagggtggtagccaaaacgttttttgcatagttcgggtaagtgttgctggtctaatgcacttaaggtgattgtataaaatccgataatctgttgactgtctaagtgtcggctaatgtaagtttttgatgtccctttttcgtgagattgccgagcgtattgtttaaaaaatcggttcatctctagatttccgcaatcaaaggcttcacgttgatgatgcttcgttaaaggctcttcaataaacttactcttcatgatagctttcctttgctaatttcgccgcttgttgtagttttgtattagctttcggcggattatcaagcaattccataatcaacgagagatcttgcggtgaaaattgccgattatcatactgctgaataatttctctggcactaggcaaaatacgttgtaatacaaattccgtaatattcgtatgggtaagtgcaacggctctaattaaagtctgcttgtcttccgtactaatgcgaatagacattctatcgttaagggcatttgcaatttgtggcataataaatatcctatttgtacagattaaagtagtacgaattttaagtgaaacagtagtaatcttcaataaaaatcacctttacaaaccacaaaaaaactttcaaactcgcaatgttgaatttaatttatttcacaaggagatttttatgacaacagttattcataccgaaaatgccccaaaagcaatcgggccttatgtacaagcggttgatttaggcaatttagtgctaacatcagggcaaattccggttaatccacaaacaggcgaagtccctacagagatcaaagctcaagctcgtcaatcccttgaaaatgtgaaagcaatcattgaacaagcgggtttatctgtggcagatattgtaaaaaccaccgtatttgtgaaagatctcaatgatttttctacggtaaatgccgaatatgaagcctttttccgtgaaaaccatcacccaaatttccctgctcgttcttgtgtcgaagttgcacgtttaccaaaagatgttggcattgagattgaagcgattgccgtgagaaaataagcgatgaaaaaaattctgccaacttggtctgttcttgatttcgttcacgcattcaccactactcgagaaggtggggtaagccaagctccctttgatagcttgaatttgggtgatcacgtcaccgatgatccacaatctgtgcaaactaaccgtgagatcttgcaagaacaagggaatttgccacattttccgctctatttaacgcaaacccatagcacaagggtgctgcgtctgccctatgaacaaaacgacattgaggcagatgcagtttataccaatcaagcaaaccaagtctgtttggtgatgacagcggattgtttgcctgtgcttttttgcagtaaagatggcaaagagattgcggcggctcacgcaggttggcgtggcttatgtgatggtgtacttgaagccacagtggcagaatttgaatgtaagccagagaatatttgtgtctggcttggtcctgcaatcggtccgaccgcatttcaagttggtgaagatgtgatagaacaattttgtgccttcgatccccaagcgagagaagcctttgtggcagatgaatatataagcggtaagttcctaggtaatctttaccagattgctcgccaacgcttaaataaacttggaattacggaaattgcagggggtgattattgtacctattgcgatgcagaacaatttttctcttaccgtagagataaagtcacagggcgaatggcaacgctgatttggcgtagtgaataattaagacttaaacaatatatatcttttcttttttacaaattggttcagaggtgttccgcctagatgaaatggtggtacattacttaaaatatatggtggattttacctctctattttatcgtaatatattgatttagttggtaggggacttccacataattctcctgtatttaaatgaaacaaacttatatttatttacaaaccgatcttctcattgtcggtggtggtatcgcagggcttgcgtgctgtgctgaagctaaggctcagggtattcaagcgacattaattaccaaagcccctatcggcagtggtgcaagtttttttccgttaaaagcaacacttggtattcaagtaactggcgagcaacaggataaagcacgctttcaagaagatattgagcgtgttgcacagggaatgaataacccgaaaattgtgcaagcctatattgaagattcgccacaggcgattgagctattagaacgtattggctttaaaccttggaaacggaatgacaatcgccccgcttgctttgcgaaatatccacgcccgatttatttgattaatcagtggcgagaagcagcggaaagagcaaggcagattatcaaagaacaggggacgacggtctatgaagatgcaacgctgttacatattgtcagcgataatcagcaagttcaaggggcgttgttttcctataaaacaagcggtgagatccgctatgtgctttgcaaaaccagccaaattattttggcaacagggggaattgcagggttgtataaagataacctctatccagccgatgtgattggttcaacccatgccattgctgaacaagcaggggcaaggctgactaacttagaatttattcagtttatccctgcttttgttgagcctaaatacaaagtgctgtttggagagcataccttaaaatatgtcagtaaagtgactgacagccaagggcgagatctgtttccacacctttcaccacagcagtttcaacagatgatgactgctcgcagtgattatgccccttttagtattgatttcccttgcgttgagtttgatttggtgatgatgaagcacttgctcgaacacccagaagaaaaaggcatttatctgcactattcccctgagctgtatcaggatcaaacggaattttacaccgtgtatttaagctggttagagaaagaagtcgggattaatcttgtgcgagatagggttgcgattacgccatttgctcacagttgtaacggcggtattgtgatcgatgaatttgccgaaagtgaagtgaaagggctttttgccgtaggcgaagtttcttcttgcattgaaggggcgaaccgtttaggtggcaattctgtcggaggtagtttggtttttgctaaacgagcaatccaacggattttgcaaaatttagcggaaaaccgaccgcttaccaacgatatagcgtgtgaacgtagtattgaacagtttttccagtcgttagcaaatccaaagggtgataaaatgctgacggcaagtgaggtgttaagcaccattcgttctcagatggcaacatacgctaatgtttatcgaacagaggcgaatttggttcaactgttgaactgcttaacgcagttagagcaacgttattgcccccttgaatatcaagcctatcaaggtattgaaatttaccacgctctcaaagccgcacaaagtgtggtaaaggcgatgctgagtaggaaagtgagtttgggagcacattatattgtttgatgtatgctattttttttcaacaagtgttgaaaaatggactacgcaaacgttttcttttttgtagaatagtttccgttttgccgaaaggcaatattgaggtatttatggttgatgcgattattatcggaattatcgttttttctttattagtcagtgtatggcgaggctttattagtgaagtctttgcgcttgtggggtggatagtagcttttttggtttctagccatttttatccttatttaagtaattacttattacaaatcaactctgtctacatccaaaattccgaatatttgcgtaatggtattgcgattgcgattttatttattgccgtgcttatcatcagtgcagtgattaacgcattactcagccaacttgttgataaaacaggtttaagcggtacagaccgtgtacttggtgctggttttggcatattaagaggcatttttattgtcgctgcgatactttttttccttgatacctttacggcatttagccaaagcgaattatggaaagaatcacaacttattccacactttgatttcattgtgaagtggttctttgaacagttacaagcaaattccagttttttaaaatctagctaatttaagaggtaattatgtgcggcattgttgggattatcggtcaaacccctgtaaatcaggcgttatatgacggacttacgttattacaacatagggggcaagatgcggcagggattgtcacaattgacgatgaaaaccgcttccgcctacgtaaagcaaatggattagtcagcgatgtgtttcgtcaagaacatatgttacgtttgcagggaaatgttggtataggacacgtccgttatccaactgcaggtagctcaagtgtatccgaagcacaaccgttttatgtaaattccccttatggtttaaccctagtacataacggcaatctcaccaacaatgcagagttaaaacgcctactgttcaacctagccaaacgccacgttaatacaaactcagattcagaatctttactcaatatatttgcttactatctcgatcaatatccacacgaactcctaacgcctgaaaatatttttgaaagcgttcgcaaaactaaccaagtgattcgtggggcttatgcttgtttatcaatgattatcggacacggaatggtggcatttcgcgatccactcggtatccgaccgcttgtacttggcaaacgagaaattgacggcaaaacagaatatatgttcgcatcagaaagtgttgcacttgatgttgtaggctttgaatatgttcgagatatacaagcaggcgaagccatttatattacctttgatggacaattctactcagcaatttgtgccgataatccgaaattaaacccttgtatctttgaatatgtctatttcgcacgtccagattctgttattgatggcgtatctgtttactcagcaagagtacatatggggaaattcttaggcgaaaaaattgcgaaagagtggacagatattttggcggatattgatgtggttatcccgattcctgaaacttctaccgatattgccttacaaattgcaacagtactgaaaaaaacttatcgccaagggtttgtgaaaaatcgctacgttgctcgaacctttattatgccagggcaggcacaacgaaaaaattcagtccgtcgcaagttgaatgccattgcctctgaatttaaaggaaaaaatgtattacttgttgatgattcaattgttcgtggcactacctcagagcagattgttgaaatggctcgacaagcgggggcaaataaagtctattttgcctcagctgcccctgaagtacgttatccaaatgtatatggtattgatatgccaacctgtgaagaactggttgcttataatcgtagcgtggaacaagttgctgaaatgattggtgtagatcgcctgattttccaagacttatcggcgctctttaagtctgttcagttagaaaatccagatattcacaactttgacgcttctgttttcactggggaatatataacaggcgatgtgagttgcgaatacttaaatgcgatagctcaagcgcgcaatgataaagccaaaaccgcccaagcgaagcaggcaggtaatttggaaattcataatgaataatcaagaatgaggcatagcagacaaaagtgttggttttaattatttcccctaattattaggcggcatagtagacaaaatgcctttagtatttgacgactaaaggcatttttcgtagggaagttaattatgattattcatctttatcgattcggctaaacaccgcactttgctgatttttatattttgcatctttacgagcattatatggatgttctgcgtaaccacttaaaatttcaaagctcaatgcaccaattgccatattaggacgtaatgcaagcggtaactttcccgcattaaaaaactcaagtacgattttgccttcccaacctggatcgatacgatgggcagtaacgtgtaccattaacccaagtcgagccaaagaagaacgaccatcaagccagccgactatgttggcaggtagtttcactgattcaagcgttgttgctaaagccagttccccagggtgtaggaaaaaggcttcatcatcggcaatcaggatttcatcactcattacacgattaagctgtgccgtcatttcttcacgtgggccgcttaaatcaatataaggcgttgaatgttcacgaaacacacggaaagaattacccaaacggacatcaatcgtcgctccactgattttttcatttgatgggcgaggcgttaggctgataatcccttcatcaagataacgttcaatatctttgtcacataaacgcataattccccctaatatattaactatgtcctaatagctgtttaatttgtgctttcaagatattaatcgcaatacggtttttaccgccttttggaataataatatccgcatactgtttagatggttcaacaaattgtaagaacattgggcgaaccgttttacgatactgatttacgatagattccattgttctgccacgctcctccatatcacgctgtaaacgacggataaaacagatatctaaaggggcatcaacgaaaatagacacattaatttcatcacgaattttttcatcagtaagtaataaaataccttcaagaatgatgatttttttaggagtgaagtgggttacggtttctttgcgattatgttctgcataatcatattctggaatatcaacagcttgcccttgtttgaggcttttaagatgggtaactaacagttcgtgatccattgagtttgggtggtcgtaattggtttttacccgttcttccattgcaagatggctttgatctcggtaataagcgtcttcagaaataataccaatatcatcttgccccaattccgcttgcaattctttgtaaatagtcgaagcaataagacttttaccagaagctgaagcccctgcaattgcaataacaatacaagattccttttgagtggtgtttgacataattaaatccttgaacacacaactggagaatttagggaattatatcgcaaaatccgtaatcttttgaagataattaccgaattttggagcctgtactaattttagtagtattcatgcttcatgtcagttcagtattcatttaaacaaatgtatagtaaacatgaattacatctaattaaatgtaggcttacaatcttcttgcttgccaaaaacttctagaccaataaggtgaattaatatctgaataaattaccccaccttttgttgaagcgtgaagaaactgcccatttttgacgtaaatgccaacatgtctgccatttggcccacgaccagttttaaaaaagacaagatcacccgtacgtaattcactctttgagatttgtatgcctgcttttgcttgatctactgttattcgaggtaaatcaataccaaataactctcggaaagtaagttgcacaaaaccagagcaatcaataccgctttttgttataccgcctagacggtagcgtgtacctttccactctctttgatgttcgcttaaactgctaatcacaaaaatggagtctgaaagctgccctttatgtttatttccgcttttatcttgaactgtactggtttttgatacacaagcggacaataaaaatgcacaaagcaacattgtgcataaagaaaaatgcttttttattaattgatagaacattttgatccttaaaaatattctgcgaaataccaagatttcgcagaataatcatttaggcttttaccttcgcattttcgacacgttcacgcaatttttgtccagctttaaaaaccacaactcggcgagcagaaactgcaatatcttcgccagttttaggattacgacctggacgagcttttttatcacgaaccgtaaaattgccaaagcctgacagttttacctcttcaccgttttctaacgagcgacgaatttcttcaaaaaagtcctcaacaaattgttttgcgatacgtttatctaaaccacatctttcgacaaggttttctgcgatttcaattttggtaagtgccataatttatccttaaaatctaatctcttagataagcattaaaacgttgtgcaagtgtttcgagaacagcttgaaacaccgcattaatttcttcctcttcaagggttttttcagtgtcttgaattgttaagctgatcgccaaacttttcttaccttcaggtaaatttgtaccttggtaaacatcaaataaattcactgccacaagtttagcgccacctgcttgtcgagccacatcaagtagatcacctgcaggtaaattgctatccacaaccacggcaatatcacgtttatttgcagggaaatgtgaaatttcttttgcatttggtactgaacgctctgcaattgcagaccataataattcaaaggcaacaggtttacctgacaatccgagtttttgaacaactttagggtgaattgtgccgatatagccgatctcttgatcgtcgagtaaaatagcagcagattgtcctgggtggaacgcaggatatgattttgcaacaaaacgtaaacgattgccagcatttgttagcgataaaacacgctctaaatccccttttagatcaaagaaatcgacgttttctgctttatgctcccaatgtgccggtcgtttatcacccacaatcactgcacctaagacaaattcttggcgtacgccattttctgcattggcatctggaataaagcgtaaaccactttcaaaaatacgcactcgattttgctggcggttttggttataagcaacggtttcaagtaagcctgttaaaagcgacacacgcattgccgacatttcacttgaaatcggatttggtagaattaacgcttcttggcttggatgtaacagctcttgcacttttggatcaacaaagctataagtaatcacttcttgataatcgctatcgaccaaagccgttctcacacgaatagcttctaaaatcttctctgggaagcctttcatctgtaaatgagcaagcggtgcgttatttggaatgctgttatagccgtaaatacgagctacttcttccacaagatcttcttcgatctcaatatcaaaacgccagcttggtgattgaactgtccagctctcgtctgcatagcttgggtttaagcctaagcgagctaaaatatcagttacggcttctgtttcaatatgatgaccgagtaagctatctaatttactacgacgtaaaaccacttgttttgacgttggtaaatgggctgaacttaccgcttctacgatttcaccagcttcaccgccacaaatttcaagcagtaacgctgtcgctctttccattgctttacgcgttaattctggatcaacgccacgttcaaaacgatgagatgcgtctgtgtgtaagccatattgtcttgcacgacctgtaattgcaagcggtgcgaagaatgcagcttctaacaccacatctttggtttcggcacttacgccactcgcttcaccaccaaaaataccagccattgcaagcggtccgttttggtctgcaattagcaaagtatttggctgaagttttgctgtcgtgccatcaagcaatacgagttcttcaccctcttttgccatacgcacttgaattgcaccattgatttttgctgcatcaaaagcgtgcattggctgaccaagttccagtaagctcagattggtaatatccacaatcggatcgatagaacggataccacaacggcgtaatttttcttgcaaccataatggtgactgtgctttgacattcacatttttcaccacacgacctaaatagagtgggcaagcttcaggggcttgaagttcaatcgtcactttatctgcaatagttgcaggcacagcttgaatttcaggtgcattcaccgctaattgattaacaaccccaacttcacgcgcaattcctgcaatgcttaaacagtccgcacggttaggcgttaaactaatttcaatggctctgtcatttaatttgagatagtcacggaaatcaataccgactggagcatctgctggcaactcaataataccgctatgatcttctttaatccctaattctgagaatgaacaaagcattccctctgatggctgaccacgcaatttagttttcttaattttaaaatcacctggtaacaccgccccatctgttgcacaagccactttcaaaccttgacggcagtttggtgcgccacaaacaatgtctaataaacgttcgccacccacattcactttggtgacacgcaatttatcggcatcagggtgttgagcacactcaaccacttctccgatcacaacaccgttaaactcacctgcaaccgcttcaacggcatcaacttctaaacctaacatagtaatttggtcacatagctgttcggtggtaatcgctggattaacccactcacgcaaccaactttcgctgaatttcactatttctatcctatatttgtaacgttttctacaaattttaccacttgttatgatagacacacgcagtgtgtccctacaagagaaaataagccattaatatagtagggacacactgcgtgtgtccgcaaactgcatatatccgcaaaatgattagattacttaaactgctttaagaaacgcagatcattttcaaagaatgaacgtaaatcggtcacgttataacgcaacatcgtcaaacgctcaacgcccattccaaccgcaaaaccagtgtattcatcaggatcaatgcccacattgcgaagtacattcgggtgaaccattccgcaacctaacacttcaagccatttaccgtttttacccattacgtccacctctgccgacggctctgtaaatgggaaataagacggacggaaacgcacttgcagatcttcttcaaagaaagctcttaagaaatcgtgcaataagccttttaactcagtaaagttcgcttttttatctacataaagcaattcaatttgatggaacatcggcgtatgggtttgatcgtagtcgttacgataaacacgccctggtgccataatgcgaataggcggttgcattttttccatagtacgaatttgaacgcctgatgtttgtgtacgcaacaaacgctctgcatcaaaccagaaagtatcgtgatctgcacgagcagggtgatgtgcagggatatttaacgcatcaaagttataataatccgtttcaatttcagggcctttttctacactaaagccaagttctgagaagaatttcaccacacgttcaattgtaatcgacacagggtgcaaaccacctaactctgttttacgaccaggtaagctcacatcaatactctcactggctaatttagcattgagttcttctgtttctaactgctcttttttcccatttaacgcatcttgtgctttctgttttgcttcattaatttttgcacccaccgcaggacgttcatctgctggcacatcacgcaagccttgcattaacaaggtaaaatgacctttcttaccaaaatattcaacacgcaatgcttcaagacttgcaacatcactggctttttcaaccgcttgcaacgcttcagcaacgatattttctaggttttgcatacctaccctctaatcaatttcaacataaataaactgaatgcctcattcataggcaaaacgccttgaataataatacttctaagcgatattgtaaatttaaaagtgaggattttgtgggggtaacattttgatttgtaacagctatcaaagataaacactgtgattattttaccatttttgctaaaaaaacaccaaatattaccgcttgttaaacattaatccgtgatcttcttgaaaacatacggtaaaatttacaccgatttgcaaaagtgcaaatcaacgctgttaaattttattggagatatacctatggcaaagaataatattttaggattattcgcacagtcgccactcaagccattacaaaagcactcaaaaaaagtgactgaatgttgtggattactaatcccattttttgaagcgagttttcaaaaaaattgggaagtagcggaagatatccgtcgtcaagtcattgatttagaaaaccgcgcagatacccttaaacgtgaaattcgtttaaaatcaccgcgtggtttatttatgcctgttgaacgtactgacttacttgaactcgttacacagctagataaattagcaaactatgctaaagatatttctggtcgtgcaatcggtcgtcaattaaacattcctgaagaaatccaacctattttccaacaattcttaacccgtagccttgatgcaacagttcacgttgataaagtaattaatgaaatggatcacctacttgaaacaggcttccgtggtcgcgaattaaattttgtgaacaatatgattttagagttagatgttatcgaagacgatacggatcaacttcaaatcgtactacgccgagcaatgttagcgattgaacaacaatacaatccaattgacattatgttcttatacaaaattatcgaatgggtcggagttcttgcagatcaagcacaacgtatcggttcacgcattgagttaatgttagctcgttcataatcgaaagaggacttaaataatggaactgattcaagaatatggctcgatgattgtcttcatcaccgcagtgtttggcttctttatggcatttggtatcggtgcaaacgatgtttcaaatgcaatgggaacctctgtaggttcaggcactatcactgcaaaacaggcaattttagttgcaatggtttttgaatttgctggtgcttatttagcaggcggtgaagtaactgaaaccatcaaaagtggcatcattgatattcaccacttctctggcagaccagacacccttgtactaggtatgatgtcggcactttttgctgcaggtacttggttattacttgcctctaaaatgggctggccagtatccactactcactctattatcggtgcaattatcggttttgcgttagtcaccgttggtgcggaagcggttcattggggtgatttgtctggtatcgtaggtagctggtttgttacacctgttgtatcggggatcattgcttatgctatttttactagcacacaaaaactgatttttgatactgataatccgatgaaaaatgctcaaaaatatggtccattctatatgggtttaaccacattcattttgagtattgttacaatgacaaaaggcttaaaacacgttggtttacagcttacaatgactgaaaccttagtgatttcaagtgcaatctcaattacgtctatcatcacttgtttcttctacttccgtagccaatcttttgctaaccgtgtacaaggcggtgcatttggtggtgtagaaaaagtgttcagcattttaatgttactcaccgcttgttcaatggcatttgcccacggttcaaacgacgtagctaatgcgattgggcctttatctgccgtagtatctatcgttgagaacggcggtgtgattgaagcgaaatcaattctcgccccttggattttaccattaggtgcaacgggtatcgttgctggtttagcggtaatgggttacaaagtaatgggaacgatcggaactggtattactgacctaaccccaagccgtggtttctcagcagaatttgcaacagcaatgaccgttgttgttgcctctggtacaggtttacctatttcaacaacacaaaccttagtaggtgcggtattaggcgtaggttttgctcgtggtattgcagcgttaaacttaacagttattcgtaatatcgttgcatcttgggttgtaaccttacctgctggtgcattcttctcgattttaattttctatattttgaatgcaattttctattaatttagaataatgactttattcagaaaagtgcggctattcgcacttttcttttatgattttttaaggattgtttatgcaaaaacatatttctcttttctgttcgacgctgcttttagcaatatcaattccctcttttgctcaaacacagtacgttactgaaaatttgaatacctatttgcgtaaaggtccaggcgatcaattcaaaatttccggttcaattcaagccggtgaaaaagttaccttaattgaaaccagggatcgctattctctcattcgtgatagtaaaaaccgtgaagcgtggattttaaattctgaattaacttctacgccaagttcaaaagaattaacaccgctattgcaacaacaagttcaagaattaaccaccaaactcaacaacattgatagagattggcaacaacgtaccgctgaaatgcaacgtagagttcaacaatctgcattacaaagcagtgaattacttgaacaaaatgcacttctaaagcgagaattagaaattattaaaaataaaaatcgtgatttagaagcaatacaagatgtcgcatctcgcgaaaattatgattcaatatttttatctacggaggagctgttctaggcttaggtttaatatttggattacttattccagcccttcttcctcgccgtaaatctaattatcgctggaattaacgcaaaacaaccgtacttttagcttactgtgatgtttttaatttgaggcatagtagacaaaagcgttggttttaattattccccctaattattaccaactctttttatttaaaaaatcctttataaacataatcttatgctttttcgttaatccgctatgaagcgataatttctgtttcagttctttaaataacccttccaacctatttgttgttttttctatatttaaatgagtatattcttcaaaagtgagcttaaagccttgtactataaggctttagcccactttttaccaacattgtctactatgcaaaatatcctatctaaatcaccgctttcattagatttccgcctattatttctagtcttttattgaataaaagttagaaaaattcttgttattttattcttagttttgtgtaactcttggttttttttttttttacaatagcgtgcggggacatttgtgcatcctgaaaatgtaaataaaggtttacgatgttttattaggaaaaacagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtacatcctgaaaatgtaaataaaggtttacgatgttttattaggaaaaacagtagagaaggttattatgaataaaatatttagagttatttgga
